United States Patent
Zhou et al.

(10) Patent No.: US 11,241,451 B2
(45) Date of Patent: Feb. 8, 2022

(54) MODULATORS OF IRF4 EXPRESSION

(71) Applicant: Ionis Pharmaceuticals, Inc., Carlsbad, CA (US)

(72) Inventors: Tianyuan Zhou, Shanghai (CN); Youngsoo Kim, San Diego, CA (US); Robert MacLeod, San Diego, CA (US); Huynh-Hoa Bui, San Diego, CA (US); Susan M. Freier, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 16/977,260

(22) PCT Filed: Mar. 1, 2019

(86) PCT No.: PCT/US2019/020201
§ 371 (c)(1),
(2) Date: Sep. 1, 2020

(87) PCT Pub. No.: WO2019/169219
PCT Pub. Date: Sep. 6, 2019

(65) Prior Publication Data
US 2021/0038631 A1    Feb. 11, 2021

Related U.S. Application Data

(60) Provisional application No. 62/637,981, filed on Mar. 2, 2018.

(51) Int. Cl.
*C12N 15/11* (2006.01)
*A61K 31/7125* (2006.01)

(52) U.S. Cl.
CPC ........ *A61K 31/7125* (2013.01); *C12N 15/111* (2013.01)

(58) Field of Classification Search
None
See application file for complete search history.

(56) References Cited

U.S. PATENT DOCUMENTS

| | | | |
|---|---|---|---|
| 3,687,808 A | 8/1972 | Merigan et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohtsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan et al. |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |

(Continued)

FOREIGN PATENT DOCUMENTS

| | | |
|---|---|---|
| WO | WO 1997/045106 | 12/1997 |
| WO | WO 2009/132126 | 10/2009 |

(Continued)

OTHER PUBLICATIONS

Branch et al., "A good antisense molecule is hard to find," TIBS (1998) 23:45-50.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Crooke et al., "Basic Principles of Antisense Therapeutics" Antisense Research and Application (1998) Chapter 1:1-50.
Crooke, ST., et al., "Antisense Drug Technology" Second Edition, CRC Press (2008) Chapters 1-28.

(Continued)

*Primary Examiner* — Ekaterina Poliakova-Georgantas
(74) *Attorney, Agent, or Firm* — Morgan, Lewis & Bockius LLP

(57) ABSTRACT

The present embodiments provide methods, compounds, and compositions useful for inhibiting IRF4 expression, which may be useful for treating, preventing, or ameliorating a cancer associated with IRF4.

22 Claims, No Drawings
Specification includes a Sequence Listing.

(56) References Cited

U.S. PATENT DOCUMENTS

| | | |
|---|---|---|
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,770,748 B2 | 8/2004 | Imanishi et al. |
| 7,015,315 B1 | 3/2006 | Cook et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,666,854 B2 | 2/2010 | Seth et al. |
| 7,687,616 B1 | 3/2010 | Bentwich et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,777,022 B2 | 8/2010 | Bentwich et al. |
| 7,875,733 B2 | 1/2011 | Bhat et al. |
| 7,888,497 B2 | 2/2011 | Bentwich et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,090,542 B2 | 1/2012 | Khvorova et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,178,503 B2 | 5/2012 | Rigoutsos et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,679,743 B2 | 3/2014 | Feldman et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,029,523 B2 | 5/2015 | Alexandrov et al. |
| 9,127,276 B2 | 8/2015 | Prakash et al. |
| 9,290,760 B2 | 3/2016 | Rajeev et al. |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |
| 2004/0171570 A1 | 9/2004 | Allerson et al. |
| 2004/0241651 A1 | 12/2004 | Olek et al. |
| 2005/0130923 A1 | 6/2005 | Bhat et al. |
| 2006/0148740 A1 | 7/2006 | Platenburg |
| 2007/0031844 A1 | 2/2007 | Khvorova et al. |
| 2008/0039618 A1 | 2/2008 | Allerson et al. |
| 2008/0318210 A1 | 12/2008 | Bentwich |
| 2010/0190837 A1 | 7/2010 | Migawa et al. |
| 2010/0197762 A1 | 8/2010 | Swayze et al. |
| 2010/0260718 A1 | 10/2010 | Ren |
| 2011/0054005 A1 | 3/2011 | Naito et al. |
| 2013/0011922 A1 | 1/2013 | Quay et al. |
| 2013/0130378 A1 | 5/2013 | Manoharan et al. |

(56) References Cited

U.S. PATENT DOCUMENTS

| | | | |
|---|---|---|---|
| 2014/0107330 A1 | 4/2014 | Freier et al. |
| 2014/0154783 A1 | 6/2014 | Rossomando et al. |
| 2015/0018540 A1 | 1/2015 | Prakash et al. |
| 2015/0099791 A1 | 4/2015 | Krieg et al. |
| 2015/0184153 A1 | 7/2015 | Freier et al. |
| 2015/0191727 A1 | 7/2015 | Migawa et al. |
| 2015/0232836 A1 | 8/2015 | Krieg et al. |
| 2015/0267195 A1 | 9/2015 | Seth et al. |
| 2015/0275212 A1 | 10/2015 | Albaek et al. |
| 2016/0369333 A1 | 12/2016 | Babiarz et al. |

FOREIGN PATENT DOCUMENTS

| | | |
|---|---|---|
| WO | WO 2013/173637 | 11/2013 |
| WO | WO 2016/180784 | 11/2016 |
| WO | WO 2019/169219 | 9/2019 |

OTHER PUBLICATIONS

Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.

Gautschi et al., "Activity of a novel bcl-2/bcl-xLbispecific antisense oligonucleotide against tumors of diverse histologic origins" J. Natl. Cancer Inst. (2001) 93:463-471.

International Search Report for PCT/US19/020201 dated Jul. 19, 2019.

Maher et al., "Comparative hybrid arrest by tandem antisense oligodeoxyribonucleotides or oligodeoxyribonucleoside methylpbosphonates in a cell-free system" Nucl. Acid. Res. (1988) 16(8): 3341-3358.

Morelli et al., "Selective targeting of IRF4 by synthetic microRNA-125b-5p mimics induces anti-multiple myeloma activity in vitro and in vivo" Leukemia (2015) 29: 2173-2183.

New England Biolabs 1998/99 Catalog (cover page and pp. 121 and 284).

Reynolds et al., "Rational siRNA design for RNA interference" Nature Biotechnology (2004) 22(3):326-330.

Sanghvi et al., "Heterocyclic Base Modifications in Nucleic Acids and Their Applications in Antisense Oligonucleotides" Antisense Research and Applications (1993) pp. 273-288.

Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.

Woolf et al., "Specificity of antisense oligonucleotides in vivo" PNAS (1992) 89: 7305-7309.

Zhou et al., "Selective Downregulation of Interferon Regulatory Factor 4 by Generation 2.5 Antisense Oligonucleotides Induces Strong Apoptosis and Sensitizes Multiple Myeloma Cells to Lenalidomide or Bortezomib" Presentation at International Conference: Molecular Targets and Cancer Therapeutics—Hynes Convention Center: Boston, MA (Oct. 19-23, 2013).

Zhou et al., "Therapeutic Targeting of Interferon Regulatory Factor 4 with Next Generation Antisense Oligonucleotides Produces Robust In Vivo Antitumor Activity in Preclinical Models of Multiple Myeloma" Presentation at 59th Annual Meeting and Exposition—Georgia World Congress Center: Atlanta, GA (Dec. 9-12, 2017).

Zhou et al., "Abstract B223: Selective Downregulation of interferon regulatory factor 4 by generation 2.5 antisense oligonucleotides induces strong apoptosis and sensitizes multiple myeloma cells to lenalidomide or bortezomib" RNA and RNA Base Technologies and Therapies (2013).

Zhou et al., "Abstract: Therapeutic Targeting of Interferon Regulatory Factor 4 with Next Generation Antisense Oligonucleotides Produces Robust In Vivo Antitumor Activity in Preclinical Models of Multiple Myeloma" Myeloma: Pathology and Pre-Clinical Studies, Excluding Therapy (2017).

MODULATORS OF IRF4 EXPRESSION

The present application is being filed along with a Sequence Listing in electronic format. The Sequence Listing is provided as a file entitled BIOL0332USASEQ_ST25.txt created Aug. 19, 2020, which is 712 kb in size. The information in the electronic format of the sequence listing is incorporated herein by reference in its entirety.

FIELD

The present embodiments provide methods, compounds, and compositions useful for inhibiting IRF4 expression, which can be useful for treating, preventing, or ameliorating a cancer associated with IRF4.

BACKGROUND

Interferon Regulatory Factor 4 (IRF4) is a transcription factor involved in immune responses in normal B and T cells, and is strongly implicated in the development of hematological malignancies, especially multiple myeloma (MM). High IRF4 levels is associated with a poor prognosis of overall survival for MM patients. Upregulation of the cereblon/IRF4 pathway accounts for the failure of lenalidomide treatment, an IMiD approved for MM and B cell malignancies. IRF4 is a component of super enhancer in MM cells in which a positive auto-regulatory loop between the oncogene MYC and IRF4 sustains the survival of MM. IRF4 is also involved in cutaneous anaplastic large cell lymphomas DLBCL, B-cell non-Hodgkin's lymphoma, ALL, adult T cell leukemia/lymphoma (ATLL), and peripheral T cell lymphoma. Despite its role in many cancers, IRF4 is considered an undruggable target by conventional therapeutic approaches.

SUMMARY

Certain embodiments provided herein are directed to potent and tolerable compounds and compositions useful for inhibiting IRF4 expression, which can be useful for treating, preventing, ameliorating, or slowing progression of cancer associated with IRF4.

DETAILED DESCRIPTION

It is to be understood that both the foregoing general description and the following detailed description are exemplary and explanatory only and are not restrictive of the embodiments, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting.

The section headings used herein are for organizational purposes only and are not to be construed as limiting the subject matter described. All documents, or portions of documents, cited in this application, including, but not limited to, patents, patent applications, articles, books, treatises, and GenBank and NCBI reference sequence records are hereby expressly incorporated by reference for the portions of the document discussed herein, as well as in their entirety.

It is understood that the sequence set forth in each SEQ ID NO in the examples contained herein is independent of any modification to a sugar moiety, an internucleoside linkage, or a nucleobase. As such, compounds defined by a SEQ ID NO may comprise, independently, one or more modifications to a sugar moiety, an internucleoside linkage, or a nucleobase. Compounds described by ION number indicate a combination of nucleobase sequence, chemical modification, and motif.

Unless otherwise indicated, the following terms have the following meanings:

"2'-deoxynucleoside" means a nucleoside comprising 2'-H(H) furanosyl sugar moiety, as found in naturally occurring deoxyribonucleic acids (DNA). In certain embodiments, a 2'-deoxynucleoside may comprise a modified nucleobase or may comprise an RNA nucleobase (uracil).

"2'-O-methoxyethyl" (also 2'-MOE and 2'-O($CH_2$)$_2$—$OCH_3$) refers to an O-methoxy-ethyl modification at the 2' position of a furanosyl ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" or "2-modified nucleoside" means a nucleoside comprising a 2'-substituted or 2'-modified sugar moiety. As used herein, "2'-substituted" or "2-modified" in reference to a sugar moiety means a sugar moiety comprising at least one 2'-substituent group other than H or OH.

"3' target site" refers to the nucleotide of a target nucleic acid which is complementary to the 3'-most nucleotide of a particular compound.

"5' target site" refers to the nucleotide of a target nucleic acid which is complementary to the 5'-most nucleotide of a particular compound.

"5-methylcytosine" means a cytosine with a methyl group attached to the 5 position.

"About" means within ±10% of a value. For example, if it is stated, "the compounds affected about 70% inhibition of IRF4", it is implied that IRF4 levels are inhibited within a range of 60% and 80%.

"Administration" or "administering" refers to routes of introducing a compound or composition provided herein to an individual to perform its intended function. An example of a route of administration that can be used includes, but is not limited to parenteral administration, such as subcutaneous, intravenous, or intramuscular injection or infusion.

"Administered concomitantly" or "co-administration" means administration of two or more compounds in any manner in which the pharmacological effects of both are manifest in the patient. Concomitant administration does not require that both compounds be administered in a single pharmaceutical composition, in the same dosage form, by the same route of administration, or at the same time. The effects of both compounds need not manifest themselves at the same time. The effects need only be overlapping for a period of time and need not be coextensive. Concomitant administration or co-administration encompasses administration in parallel or sequentially.

"Amelioration" refers to an improvement or lessening of at least one indicator, sign, or symptom of an associated disease, disorder, or condition. In certain embodiments, amelioration includes a delay or slowing in the progression or severity of one or more indicators of a condition or disease. The progression or severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable and/or measurable activity attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound to the target.

"Antisense compound" means a compound comprising an oligonucleotide and optionally one or more additional features, such as a conjugate group or terminal group. Examples of antisense compounds include single-stranded and double-stranded compounds, such as, oligonucleotides, ribozymes, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means an oligonucleotide having a nucleobase sequence that is complementary to a target nucleic acid or region or segment thereof. In certain embodiments, an antisense oligonucleotide is specifically hybridizable to a target nucleic acid or region or segment thereof.

"Bicyclic nucleoside" or "BNA" means a nucleoside comprising a bicyclic sugar moiety. "Bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

"Branching group" means a group of atoms having at least 3 positions that are capable of forming covalent linkages to at least 3 groups. In certain embodiments, a branching group provides a plurality of reactive sites for connecting tethered ligands to an oligonucleotide via a conjugate linker and/or a cleavable moiety.

"Cell-targeting moiety" means a conjugate group or portion of a conjugate group that is capable of binding to a particular cell type or particular cell types.

"cEt" or "constrained ethyl" means a bicyclic furanosyl sugar moiety comprising a bridge connecting the 4'-carbon and the 2'-carbon, wherein the bridge has the formula: 4'-CH(CH$_3$)—O-2'.

"cEt nucleoside" means a nucleoside comprising a cEt modified sugar moiety.

"Chemical modification" in a compound describes the substitutions or changes through chemical reaction, of any of the units in the compound relative to the original state of such unit. "Modified nucleoside" means a nucleoside having, independently, a modified sugar moiety and/or modified nucleobase. "Modified oligonucleotide" means an oligonucleotide comprising at least one modified internucleoside linkage, a modified sugar, and/or a modified nucleobase.

"Chemically distinct region" refers to a region of a compound that is in some way chemically different than another region of the same compound. For example, a region having 2'-O-methoxyethyl nucleotides is chemically distinct from a region having nucleotides without 2'-O-methoxyethyl modifications.

"Chimeric antisense compounds" means antisense compounds that have at least 2 chemically distinct regions, each position having a plurality of subunits.

"Chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more sterorandom chiral centers. In certain embodiments, the molecules are modified oligonucleotides. In certain embodiments, the molecules are compounds comprising modified oligonucleotides.

"Cleavable bond" means any chemical bond capable of being split. In certain embodiments, a cleavable bond is selected from among: an amide, a polyamide, an ester, an ether, one or both esters of a phosphodiester, a phosphate ester, a carbamate, a di-sulfide, or a peptide.

"Cleavable moiety" means a bond or group of atoms that is cleaved under physiological conditions, for example, inside a cell, an animal, or a human.

"Complementary" in reference to an oligonucleotide means the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine ($^m$C) and guanine (G) unless otherwise specified. Complementary oligonucleotides and/or nucleic acids need not have nucleobase complementarity at each nucleoside and may include one or more nucleobase mismatches. By contrast, "fully complementary" or "100% complementary" in reference to oligonucleotides means that such oligonucleotides have nucleobase matches at each nucleoside without any nucleobase mismatches.

"Conjugate group" means a group of atoms that is attached to an oligonucleotide. Conjugate groups include a conjugate moiety and a conjugate linker that attaches the conjugate moiety to the oligonucleotide.

"Conjugate linker" means a group of atoms comprising at least one bond that connects a conjugate moiety to an oligonucleotide.

"Conjugate moiety" means a group of atoms that is attached to an oligonucleotide via a conjugate linker.

"Contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

"Designing" or "Designed to" refer to the process of designing a compound that specifically hybridizes with a selected nucleic acid molecule.

"Diluent" means an ingredient in a composition that lacks pharmacological activity, but is pharmaceutically necessary or desirable. For example, the diluent in an injected composition can be a liquid, e.g. saline solution.

"Differently modified" means chemical modifications or chemical substituents that are different from one another, including absence of modifications. Thus, for example, a MOE nucleoside and an unmodified DNA nucleoside are "differently modified," even though the DNA nucleoside is unmodified. Likewise, DNA and RNA are "differently modified," even though both are naturally-occurring unmodified nucleosides. Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

"Dose" means a specified quantity of a compound or pharmaceutical agent provided in a single administration, or in a specified time period. In certain embodiments, a dose may be administered in two or more boluses, tablets, or injections. For example, in certain embodiments, where subcutaneous administration is desired, the desired dose may require a volume not easily accommodated by a single injection. In such embodiments, two or more injections may be used to achieve the desired dose. In certain embodiments, a dose may be administered in two or more injections to minimize injection site reaction in an individual. In other embodiments, the compound or pharmaceutical agent is administered by infusion over an extended period of time or continuously. Doses may be stated as the amount of pharmaceutical agent per hour, day, week or month.

"Dosing regimen" is a combination of doses designed to achieve one or more desired effects.

"Double-stranded antisense compound" means an antisense compound comprising two oligomeric compounds that are complementary to each other and form a duplex, and wherein one of the two said oligomeric compounds comprises an oligonucleotide.

"Effective amount" means the amount of compound sufficient to effectuate a desired physiological outcome in an individual in need of the compound. The effective amount may vary among individuals depending on the health and physical condition of the individual to be treated, the taxonomic group of the individuals to be treated, the formulation of the composition, assessment of the individual's medical condition, and other relevant factors.

"Efficacy" means the ability to produce a desired effect.

"Expression" includes all the functions by which a gene's coded information is converted into structures present and operating in a cell. Such structures include, but are not limited to, the products of transcription and translation.

"Gapmer" means an oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings."

"Hybridization" means the annealing of oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases. In certain embodiments, complementary nucleic acid molecules include, but are not limited to, an antisense compound and a nucleic acid target. In certain embodiments, complementary nucleic acid molecules include, but are not limited to, an oligonucleotide and a nucleic acid target.

"Immediately adjacent" means there are no intervening elements between the immediately adjacent elements of the same kind (e.g. no intervening nucleobases between the immediately adjacent nucleobases).

"Individual" means a human or non-human animal selected for treatment or therapy.

"Inhibiting the expression or activity" refers to a reduction or blockade of the expression or activity relative to the expression of activity in an untreated or control sample and does not necessarily indicate a total elimination of expression or activity.

"Internucleoside linkage" means a group or bond that forms a covalent linkage between adjacent nucleosides in an oligonucleotide. "Modified internucleoside linkage" means any internucleoside linkage other than a naturally occurring, phosphate internucleoside linkage. Non-phosphate linkages are referred to herein as modified internucleoside linkages.

"Lengthened oligonucleotides" are those that have one or more additional nucleosides relative to an oligonucleotide disclosed herein, e.g. a parent oligonucleotide.

"Linked nucleosides" means adjacent nucleosides linked together by an internucleoside linkage.

"Linker-nucleoside" means a nucleoside that links an oligonucleotide to a conjugate moiety. Linker-nucleosides are located within the conjugate linker of a compound. Linker-nucleosides are not considered part of the oligonucleotide portion of a compound even if they are contiguous with the oligonucleotide.

"Mismatch" or "non-complementary" means a nucleobase of a first oligonucleotide that is not complementary to the corresponding nucleobase of a second oligonucleotide or target nucleic acid when the first and second oligonucleotides are aligned. For example, nucleobases including but not limited to a universal nucleobase, inosine, and hypoxanthine, are capable of hybridizing with at least one nucleobase but are still mismatched or non-complementary with respect to nucleobase to which it hybridized. As another example, a nucleobase of a first oligonucleotide that is not capable of hybridizing to the corresponding nucleobase of a second oligonucleotide or target nucleic acid when the first and second oligonucleotides are aligned is a mismatch or non-complementary nucleobase.

"Modulating" refers to changing or adjusting a feature in a cell, tissue, organ or organism. For example, modulating IRF4 RNA can mean to increase or decrease the level of IRF4 RNA and/or IRF4 protein in a cell, tissue, organ or organism. A "modulator" effects the change in the cell, tissue, organ or organism. For example, a IRF4 compound can be a modulator that decreases the amount of IRF4 RNA and/or IRF4 protein in a cell, tissue, organ or organism.

"MOE" means methoxyethyl.

"Monomer" refers to a single unit of an oligomer. Monomers include, but are not limited to, nucleosides and nucleotides.

"Motif" means the pattern of unmodified and/or modified sugar moieties, nucleobases, and/or internucleoside linkages, in an oligonucleotide.

"Natural" or "naturally occurring" means found in nature.

"Non-bicyclic modified sugar" or "non-bicyclic modified sugar moiety" means a modified sugar moiety that comprises a modification, such as a substituent, that does not form a bridge between two atoms of the sugar to form a second ring.

"Nucleic acid" refers to molecules composed of monomeric nucleotides. A nucleic acid includes, but is not limited to, ribonucleic acids (RNA), deoxyribonucleic acids (DNA), single-stranded nucleic acids, and double-stranded nucleic acids.

"Nucleobase" means a heterocyclic moiety capable of pairing with a base of another nucleic acid. As used herein a "naturally occurring nucleobase" is adenine (A), thymine (T), cytosine (C), uracil (U), and guanine (G). A "modified nucleobase" is a naturally occurring nucleobase that is chemically modified. A "universal base" or "universal nucleobase" is a nucleobase other than a naturally occurring nucleobase and modified nucleobase, and is capable of pairing with any nucleobase.

"Nucleobase sequence" means the order of contiguous nucleobases in a nucleic acid or oligonucleotide independent of any sugar or internucleoside linkage.

"Nucleoside" means a compound comprising a nucleobase and a sugar moiety. The nucleobase and sugar moiety are each, independently, unmodified or modified. "Modified nucleoside" means a nucleoside comprising a modified nucleobase and/or a modified sugar moiety. Modified nucleosides include abasic nucleosides, which lack a nucleobase.

"Oligomeric compound" means a compound comprising a single oligonucleotide and optionally one or more additional features, such as a conjugate group or terminal group.

"Oligonucleotide" means a polymer of linked nucleosides each of which can be modified or unmodified, independent one from another. Unless otherwise indicated, oligonucleotides consist of 8-80 linked nucleosides. "Modified oligonucleotide" means an oligonucleotide, wherein at least one sugar, nucleobase, or internucleoside linkage is modified. "Unmodified oligonucleotide" means an oligonucleotide that does not comprise any sugar, nucleobase, or internucleoside modification.

"Parent oligonucleotide" means an oligonucleotide whose sequence is used as the basis of design for more oligonucleotides of similar sequence but with different lengths, motifs, and/or chemistries. The newly designed oligonucleotides may have the same or overlapping sequence as the parent oligonucleotide.

"Parenteral administration" means administration through injection or infusion. Parenteral administration includes subcutaneous administration, intravenous administration, intramuscular administration, intraarterial administration, intraperitoneal administration, or intracranial administration, e.g. intrathecal or intracerebroventricular administration.

"Pharmaceutically acceptable carrier or diluent" means any substance suitable for use in administering to an individual. For example, a pharmaceutically acceptable carrier can be a sterile aqueous solution, such as PBS or water-for-injection.

"Pharmaceutically acceptable salts" means physiologically and pharmaceutically acceptable salts of compounds, such as oligomeric compounds or oligonucleotides, i.e., salts that retain the desired biological activity of the parent compound and do not impart undesired toxicological effects thereto.

"Pharmaceutical agent" means a compound that provides a therapeutic benefit when administered to an individual.

"Pharmaceutical composition" means a mixture of substances suitable for administering to an individual. For example, a pharmaceutical composition may comprise one or more compounds or salt thereof and a sterile aqueous solution.

"Phosphorothioate linkage" means a modified phosphate linkage in which one of the non-bridging oxygen atoms is replaced with a sulfur atom. A phosphorothioate internucleoside linkage is a modified internucleoside linkage.

"Phosphorus moiety" means a group of atoms comprising a phosphorus atom. In certain embodiments, a phosphorus moiety comprises a mono-, di-, or tri-phosphate, or phosphorothioate.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an oligomeric compound.

"Prevent" refers to delaying or forestalling the onset, development or progression of a disease, disorder, or condition for a period of time from minutes to indefinitely.

"Prodrug" means a compound in a form outside the body which, when administered to an individual, is metabolized to another form within the body or cells thereof. In certain embodiments, the metabolized form is the active, or more active, form of the compound (e.g., drug). Typically conversion of a prodrug within the body is facilitated by the action of an enzyme(s) (e.g., endogenous or viral enzyme) or chemical(s) present in cells or tissues, and/or by physiologic conditions.

"Reduce" means to bring down to a smaller extent, size, amount, or number.

"RefSeq No." is a unique combination of letters and numbers assigned to a sequence to indicate the sequence is for a particular target transcript (e.g., target gene). Such sequence and information about the target gene (collectively, the gene record) can be found in a genetic sequence database. Genetic sequence databases include the NCBI Reference Sequence database, GenBank, the European Nucleotide Archive, and the DNA Data Bank of Japan (the latter three forming the International Nucleotide Sequence Database Collaboration or INSDC).

"Region" is defined as a portion of the target nucleic acid having at least one identifiable structure, function, or characteristic.

"RNAi compound" means an antisense compound that acts, at least in part, through RISC or Ago2, but not through RNase H, to modulate a target nucleic acid and/or protein encoded by a target nucleic acid. RNAi compounds include, but are not limited to double-stranded siRNA, single-stranded RNA (ssRNA), and microRNA, including microRNA mimics.

"Segments" are defined as smaller or sub-portions of regions within a nucleic acid.

"Side effects" means physiological disease and/or conditions attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum may indicate liver toxicity or liver function abnormality. For example, increased bilirubin may indicate liver toxicity or liver function abnormality.

"Single-stranded" in reference to a compound means the compound has only one oligonucleotide. "Self-complementary" means an oligonucleotide that at least partially hybridizes to itself. A compound consisting of one oligonucleotide, wherein the oligonucleotide of the compound is self-complementary, is a single-stranded compound. A single-stranded compound may be capable of binding to a complementary compound to form a duplex.

"Sites" are defined as unique nucleobase positions within a target nucleic acid.

"Specifically hybridizable" refers to an oligonucleotide having a sufficient degree of complementarity between the oligonucleotide and a target nucleic acid to induce a desired effect, while exhibiting minimal or no effects on non-target nucleic acids. In certain embodiments, specific hybridization occurs under physiological conditions.

"Specifically inhibit" with reference to a target nucleic acid means to reduce or block expression of the target nucleic acid while exhibiting fewer, minimal, or no effects on non-target nucleic acids. Reduction does not necessarily indicate a total elimination of the target nucleic acid's expression.

"Standard cell assay" means assay(s) described in the Examples and reasonable variations thereof.

"Standard in vivo experiment" means the procedure(s) described in the Example(s) and reasonable variations thereof.

"Stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

"Sugar moiety" means an unmodified sugar moiety or a modified sugar moiety. "Unmodified sugar moiety" or "unmodified sugar" means a 2'-OH(H) furanosyl moiety, as found in RNA (an "unmodified RNA sugar moiety"), or a 2'-H(H) moiety, as found in DNA (an "unmodified DNA sugar moiety"). Unmodified sugar moieties have one hydrogen at each of the 1', 3', and 4' positions, an oxygen at the 3' position, and two hydrogens at the 5' position. "Modified sugar moiety" or "modified sugar" means a modified furanosyl sugar moiety or a sugar surrogate. "Modified furanosyl sugar moiety" means a furanosyl sugar comprising a non-hydrogen substituent in place of at least one hydrogen of an unmodified sugar moiety. In certain embodiments, a modified furanosyl sugar moiety is a 2'-substituted sugar moiety. Such modified furanosyl sugar moieties include bicyclic sugars and non-bicyclic sugars.

"Sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary compounds or nucleic acids.

"Synergy" or "synergize" refers to an effect of a combination that is greater than additive of the effects of each component alone at the same doses.

"IRF4" means any nucleic acid or protein of IRF4. "IRF4 nucleic acid" means any nucleic acid encoding IRF4. For example, in certain embodiments, a IRF4 nucleic acid includes a DNA sequence encoding IRF4, an RNA sequence transcribed from DNA encoding IRF4 (including genomic DNA comprising introns and exons), and an mRNA sequence encoding IRF4. "IRF4 mRNA" means an mRNA encoding a IRF4 protein. The target may be referred to in either upper or lower case.

"IRF4 specific inhibitor" refers to any agent capable of specifically inhibiting IRF4 RNA and/or IRF4 protein expression or activity at the molecular level. For example, IRF4 specific inhibitors include nucleic acids (including antisense compounds), peptides, antibodies, small molecules, and other agents capable of inhibiting the expression of IRF4 RNA and/or IRF4 protein.

"Target gene" refers to a gene encoding a target.

"Targeting" means the specific hybridization of a compound to a target nucleic acid in order to induce a desired effect.

"Target nucleic acid," "target RNA," "target RNA transcript" and "nucleic acid target" all mean a nucleic acid capable of being targeted by compounds described herein.

"Target region" means a portion of a target nucleic acid to which one or more compounds is targeted.

"Target segment" means the sequence of nucleotides of a target nucleic acid to which a compound is targeted. "5' target site" refers to the 5'-most nucleotide of a target segment. "3' target site" refers to the 3'-most nucleotide of a target segment.

"Terminal group" means a chemical group or group of atoms that is covalently linked to a terminus of an oligonucleotide.

"Therapeutically effective amount" means an amount of a compound, pharmaceutical agent, or composition that provides a therapeutic benefit to an individual.

"Treat" refers to administering a compound or pharmaceutical composition to an animal in order to effect an alteration or improvement of a disease, disorder, or condition in the animal.

CERTAIN EMBODIMENTS

Certain embodiments provide methods, compounds and compositions for inhibiting IRF4 expression.

Certain embodiments provide compounds targeted to a IRF4 nucleic acid. In certain embodiments, the IRF4 nucleic acid has the sequence set forth in RefSeq or GENBANK Accession No. NM_002460.3 or NT_034880.3TRUNC 328000 354000 (incorporated by reference, disclosed herein as SEQ ID NO: 1 and SEQ ID NO: 2, respectively). In certain embodiments, the compound is an antisense compound or oligomeric compound. In certain embodiments, the compound is single-stranded. In certain embodiments, the compound is double-stranded.

Certain embodiments provide a compound comprising a modified oligonucleotide 8 to 80 linked nucleosides in length and having a nucleobase sequence comprising at least 8 contiguous nucleobases of any of the nucleobase sequences of SEQ ID NOs: 3-3383. In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length.

Certain embodiments provide a compound comprising a modified oligonucleotide 9 to 80 linked nucleosides in length and having a nucleobase sequence comprising at least 9 contiguous nucleobases of any of the nucleobase sequences of SEQ ID NOs: 3-3383. In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length.

Certain embodiments provide a compound comprising a modified oligonucleotide 10 to 80 linked nucleosides in length and having a nucleobase sequence comprising at least 10 contiguous nucleobases of any of the nucleobase sequences of SEQ ID NOs: 3-3383. In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length.

Certain embodiments provide a compound comprising a modified oligonucleotide 11 to 80 linked nucleosides in length and having a nucleobase sequence comprising at least 11 contiguous nucleobases of any of the nucleobase sequences of SEQ ID NOs: 3-3383. In certain embodiments, the compound is an antisense compound or oligomeric compound. In certain embodiments, the compound is single-stranded. In certain embodiments, the compound is double-stranded. In certain embodiments, the modified oligonucleotide is 11 to 30 linked nucleosides in length.

Certain embodiments provide a compound comprising a modified oligonucleotide 12 to 80 linked nucleosides in length and having a nucleobase sequence comprising at least 12 contiguous nucleobases of any of the nucleobase sequences of SEQ ID NOs: 3-3383. In certain embodiments, the compound is an antisense compound or oligomeric compound. In certain embodiments, the compound is single-stranded. In certain embodiments, the compound is double-stranded. In certain embodiments, the modified oligonucleotide is 12 to 30 linked nucleosides in length.

Certain embodiments provide a compound comprising a modified oligonucleotide 16 to 80 linked nucleosides in length and having a nucleobase sequence comprising the nucleobase sequence of any one of SEQ ID NOs: 3-3383. In certain embodiments, the compound is an antisense compound or oligomeric compound. In certain embodiments, the compound is single-stranded. In certain embodiments, the compound is double-stranded. In certain embodiments, the modified oligonucleotide is 16 to 30 linked nucleosides in length.

Certain embodiments provide a compound comprising a modified oligonucleotide consisting of the nucleobase sequence of any one of SEQ ID NOs: 3-3383. In certain embodiments, the compound is an antisense compound or oligomeric compound. In certain embodiments, the compound is single-stranded. In certain embodiments, the compound is double-stranded.

In certain embodiments, a compound comprises a modified oligonucleotide 8 to 80 linked nucleosides in length and having at least an 8, 9, 10, 11, 12, 13, 14, 15, or 16 contiguous nucleobase portion complementary to an equal length portion within the 3'UTR of SEQ ID NO: 1. In certain embodiments, the 3'UTR corresponds to nucleotides 1483 to 5332 of SEQ ID NO: 1. In certain embodiments, a compound comprises a modified oligonucleotide 10 to 30 linked nucleosides in length having a nucleobase sequence at least 85%, at least 90%, at least 95%, or 100% complementary across its entire length to a nucleobase sequence within the 3'UTR of SEQ ID NO: 1. In certain embodiments, the 3'UTR corresponds to nucleotides 1483 to 5332 of SEQ ID NO: 1. In certain embodiments, a compound comprises a modified oligonucleotide 16 to 30 linked nucleosides in length having a nucleobase sequence at least 85%, at least 90%, at least 95%, or 100% complementary across its entire length to a nucleobase sequence within the 3'UTR of SEQ ID NO: 1. In certain embodiments, the 3'UTR corresponds to nucleotides 1483 to 5332 of SEQ ID NO: 1.

In certain embodiments, a compound comprises a modified oligonucleotide 8 to 80 linked nucleosides in length and having at least an 8, 9, 10, 11, 12, 13, 14, 15, or 16 contiguous nucleobase portion complementary to an equal length portion within nucleotides 4227-4244, 4227-4242, 4228-4243, or 4229-4244 of SEQ ID NO: 1. In certain embodiments, the modified oligonucleotide is 10 to 30 linked nucleosides in length. In certain embodiments, the modified oligonucleotide is 16 to 30 linked nucleosides in length.

In certain embodiments, a compound comprises a modified oligonucleotide 8 to 80 linked nucleosides in length and having at least an 8, 9, 10, 11, 12, 13, 14, 15, or 16 contiguous nucleobase portion complementary to an equal length portion within nucleotides 9667-9682, 11411-11426, or 18090-18105 of SEQ ID NO: 2. In certain embodiments, the modified oligonucleotide is 10 to 30 linked nucleosides in length. In certain embodiments, the modified oligonucleotide is 16 to 30 linked nucleosides in length.

In certain embodiments, a compound comprises a modified oligonucleotide 8 to 80 linked nucleosides in length and complementary within nucleotides 4227-4244, 4227-4242, 4228-4243, or 4229-4244 of SEQ ID NO: 1. In certain embodiments, the modified oligonucleotide is 10 to 30 linked nucleosides in length. In certain embodiments, the modified oligonucleotide is 16 to 30 linked nucleosides in length.

In certain embodiments, a compound comprises a modified oligonucleotide 8 to 80 linked nucleosides in length and complementary within nucleotides 9667-9682, 11411-11426, or 18090-18105 of SEQ ID NO: 2. In certain embodiments, the modified oligonucleotide is 10 to 30 linked nucleosides in length. In certain embodiments, the modified oligonucleotide is 16 to 30 linked nucleosides in length.

In certain embodiments, a compound comprises a modified oligonucleotide 8 to 80 linked nucleosides in length and having a nucleobase sequence comprising at least an 8, 9, 10, 11, 12, 13, 14, 15, or 16 contiguous nucleobase portion any one of SEQ ID NOs: 2021, 560, 559, 1330, 1540, or 3303. In certain embodiments, the modified oligonucleotide is 10 to 30 linked nucleosides in length. In certain embodiments, the modified oligonucleotide is 16 to 30 linked nucleosides in length.

In certain embodiments, a compound comprises a modified oligonucleotide 16 to 80 linked nucleosides in length and having a nucleobase sequence comprising any one of SEQ ID NOs: 2021, 560, 559, 1330, 1540, or 3303. In certain embodiments, the modified oligonucleotide is 16 to 30 linked nucleosides in length.

In certain embodiments, a compound comprises a modified oligonucleotide 16 linked nucleosides in length having a nucleobase sequence consisting of any one of SEQ ID NOs: 2021, 560, 559, 1330, 1540, or 3303.

In certain embodiments, a compound targeted to IRF4 is ION 935918. Out of over 3,000 compounds that were screened as described in the Examples section below, ION 690890, 935658, 935696, 935762, 935918, 935968, 882800, 1012795, 1014095, and 1014834 emerged as the top lead compounds. In particular, ION 935918 exhibited the best combination of properties in terms of potency and tolerability out of over 3,000 compounds.

In certain embodiments, any of the foregoing modified oligonucleotides comprises at least one modified internucleoside linkage, at least one modified sugar, and/or at least one modified nucleobase.

In certain embodiments, any of the foregoing modified oligonucleotides comprises at least one modified sugar. In certain embodiments, at least one modified sugar comprises a 2'-O-methoxyethyl group. In certain embodiments, at least one modified sugar is a bicyclic sugar, such as a 4'-CH (CH$_3$)—O-2' group, a 4'-CH$_2$—O-2' group, or a 4'-(CH$_2$)$_2$—O-2' group.

In certain embodiments, the modified oligonucleotide comprises at least one modified internucleoside linkage, such as a phosphorothioate internucleoside linkage.

In certain embodiments, any of the foregoing modified oligonucleotides comprises at least one modified nucleobase, such as 5-methylcytosine.

In certain embodiments, any of the foregoing modified oligonucleotides comprises:
  a gap segment consisting of linked deoxynucleosides;
  a 5' wing segment consisting of linked nucleosides; and
  a 3' wing segment consisting of linked nucleosides;
  wherein the gap segment is positioned between the 5' wing segment and the 3' wing segment and wherein each nucleoside of each wing segment comprises a modified sugar. In certain embodiments, the modified oligonucleotide is 16 to 80 linked nucleosides in length having a nucleobase sequence comprising the sequence recited in any one of SEQ ID NO: 2021, 560, 559, 1330, 1540, or 3303. In certain embodiments, the modified oligonucleotide is 16 to 30 linked nucleosides in length having a nucleobase sequence comprising the sequence recited in any one of SEQ ID NOs: 2021, 560, 559, 1330, 1540, or 3303. In certain embodiments, the modified oligonucleotide is 16 linked nucleosides in length having a nucleobase sequence consisting of the sequence recited in any one of SEQ ID NOs: 2021, 560, 559, 1330, 1540, or 3303.

In certain embodiments, a compound comprises or consists of a modified oligonucleotide 16-80 linked nucleobases in length having a nucleobase sequence comprising the sequence recited in any one of SEQ ID NOs: 3-3383, wherein the modified oligonucleotide comprises:
  a gap segment consisting of linked deoxynucleosides;
  a 5' wing segment consisting of linked nucleosides; and
  a 3' wing segment consisting of linked nucleosides;
  wherein the gap segment is positioned between the 5' wing segment and the 3' wing segment and wherein each nucleoside of each wing segment comprises a modified sugar. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-80 linked nucleobases in length having a nucleobase sequence comprising the sequence recited in any one of SEQ ID NOs: 2021, 560, 559, 1330, 1540, or 3303, wherein the modified oligonucleotide comprises:
  a gap segment consisting of linked deoxynucleosides;
  a 5' wing segment consisting of linked nucleosides; and
  a 3' wing segment consisting of linked nucleosides;
  wherein the gap segment is positioned between the 5' wing segment and the 3' wing segment and wherein each nucleoside of each wing segment comprises a modified sugar. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-80 linked nucleobases in length having a nucleobase sequence comprising the sequence recited in any one of SEQ ID NOs: 1330 or 3303, wherein the modified oligonucleotide comprises:
  a gap segment consisting of ten linked deoxynucleosides;
  a 5' wing segment consisting of three linked nucleosides; and
  a 3' wing segment consisting of three linked nucleosides;
  wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-80 linked nucleobases in length having a nucleobase sequence comprising the sequence recited in any one of SEQ ID NOs: 559 or 560, wherein the modified oligonucleotide comprises:
  a gap segment consisting of ten linked deoxynucleosides;
  a 5' wing segment consisting of one linked nucleoside; and
  a 3' wing segment consisting of five linked nucleosides;
  wherein the gap segment is positioned between the 5' wing segment and the 3' wing segment; wherein the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-80 linked nucleobases in length having a nucleobase sequence comprising the sequence recited in any one of SEQ ID NOs: 1330 or 2021, wherein the modified oligonucleotide comprises:
  a gap segment consisting of ten linked deoxynucleosides;
  a 5' wing segment consisting of two linked nucleosides; and
  a 3' wing segment consisting of four linked nucleosides;
  wherein the gap segment is positioned between the 5' wing segment and the 3' wing segment; wherein each nucleoside of the 5' wing segment comprises a cEt nucleoside; wherein the 3' wing segment comprises a cEt nucleoside, a 2'-O-methoxyethyl nucleoside, a cEt nucleoside, and a 2'-O-methoxyethyl nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-80 linked nucleobases in length having a nucleobase sequence comprising the sequence recited in SEQ ID NO: 560, wherein the modified oligonucleotide comprises:
  a gap segment consisting of nine linked deoxynucleosides;
  a 5' wing segment consisting of two linked nucleosides; and a 3' wing segment consisting of five linked nucleosides;
wherein the gap segment is positioned between the 5' wing segment and the 3' wing segment; wherein each nucleoside of the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-80 linked nucleobases in length having a nucleobase sequence comprising the sequence recited in SEQ ID NOs: 2021, wherein the modified oligonucleotide comprises:
a gap segment consisting of nine linked deoxynucleosides;
a 5' wing segment consisting of two linked nucleosides; and
a 3' wing segment consisting of five linked nucleosides;
wherein the gap segment is positioned between the 5' wing segment and the 3' wing segment; wherein each nucleoside of the 5' wing segment comprises a cEt nucleoside; wherein the 3' wing segment comprises a 2'-O-methoxyethyl nucleoside, a 2'-O-methoxyethyl nucleoside, a 2'-O-methoxyethyl nucleoside, a cEt nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-80 linked nucleobases in length having a nucleobase sequence comprising the sequence recited in SEQ ID NOs: 1540, wherein the modified oligonucleotide comprises:
a gap segment consisting of nine linked deoxynucleosides;
a 5' wing segment consisting of two linked nucleosides; and
a 3' wing segment consisting of five linked nucleosides;
wherein the gap segment is positioned between the 5' wing segment and the 3' wing segment; wherein each nucleoside of the 5' wing segment comprises a cEt nucleoside; wherein the 3' wing segment comprises a 2'-O-methoxyethyl nucleoside, a 2'-O-methoxyethyl nucleoside, a 2'-O-methoxyethyl nucleoside, a cEt nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-80 linked nucleobases in length having a nucleobase sequence comprising the sequence recited in SEQ ID NOs: 560, wherein the modified oligonucleotide comprises:
a gap segment consisting of nine linked deoxynucleosides;
a 5' wing segment consisting of two linked nucleosides; and
a 3' wing segment consisting of five linked nucleosides;
wherein the gap segment is positioned between the 5' wing segment and the 3' wing segment; wherein each nucleoside of the 5' wing segment comprises a cEt nucleoside; wherein the 3' wing segment comprises a 2'-O-methoxyethyl nucleoside, a cEt nucleoside, a 2'-O-methoxyethyl nucleoside, a cEt nucleoside, and a 2'-O-methoxyethyl nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In certain embodiments, a compound comprises or consists of ION 935918 or salt thereof, having the following chemical structure:

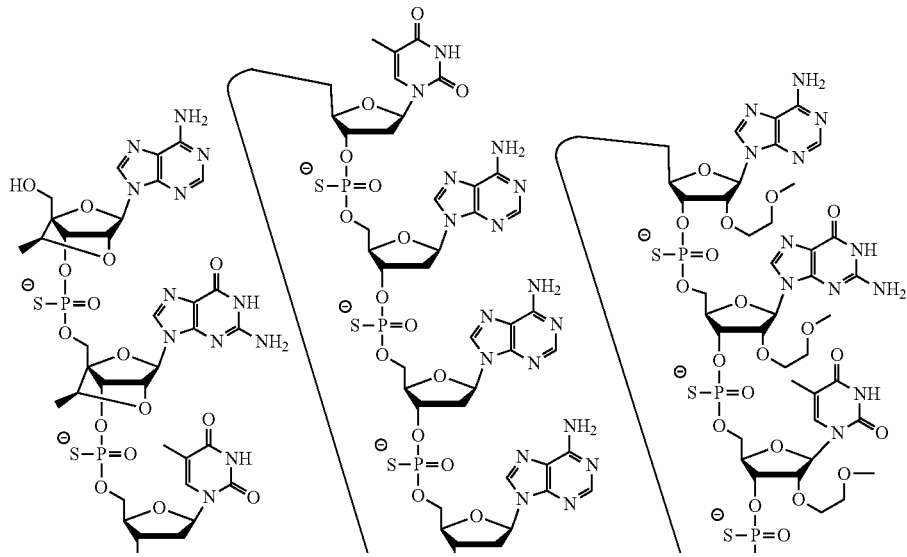

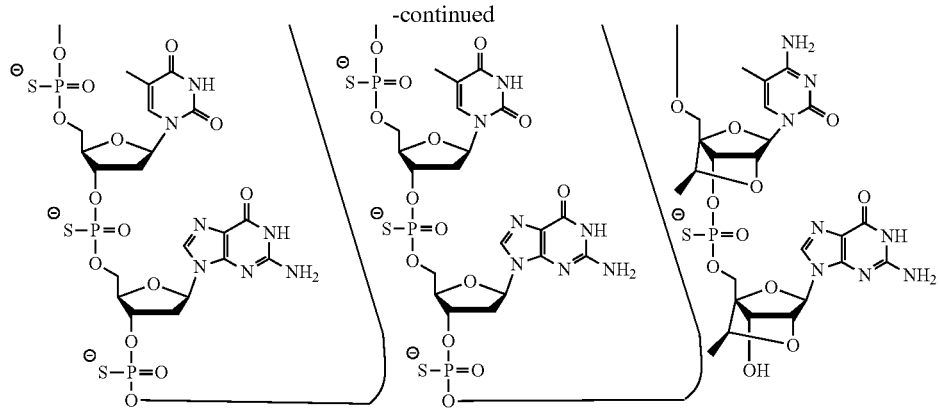
In certain embodiments, a compound comprises or consists of the sodium salt of ION 935918, having the following chemical structure:
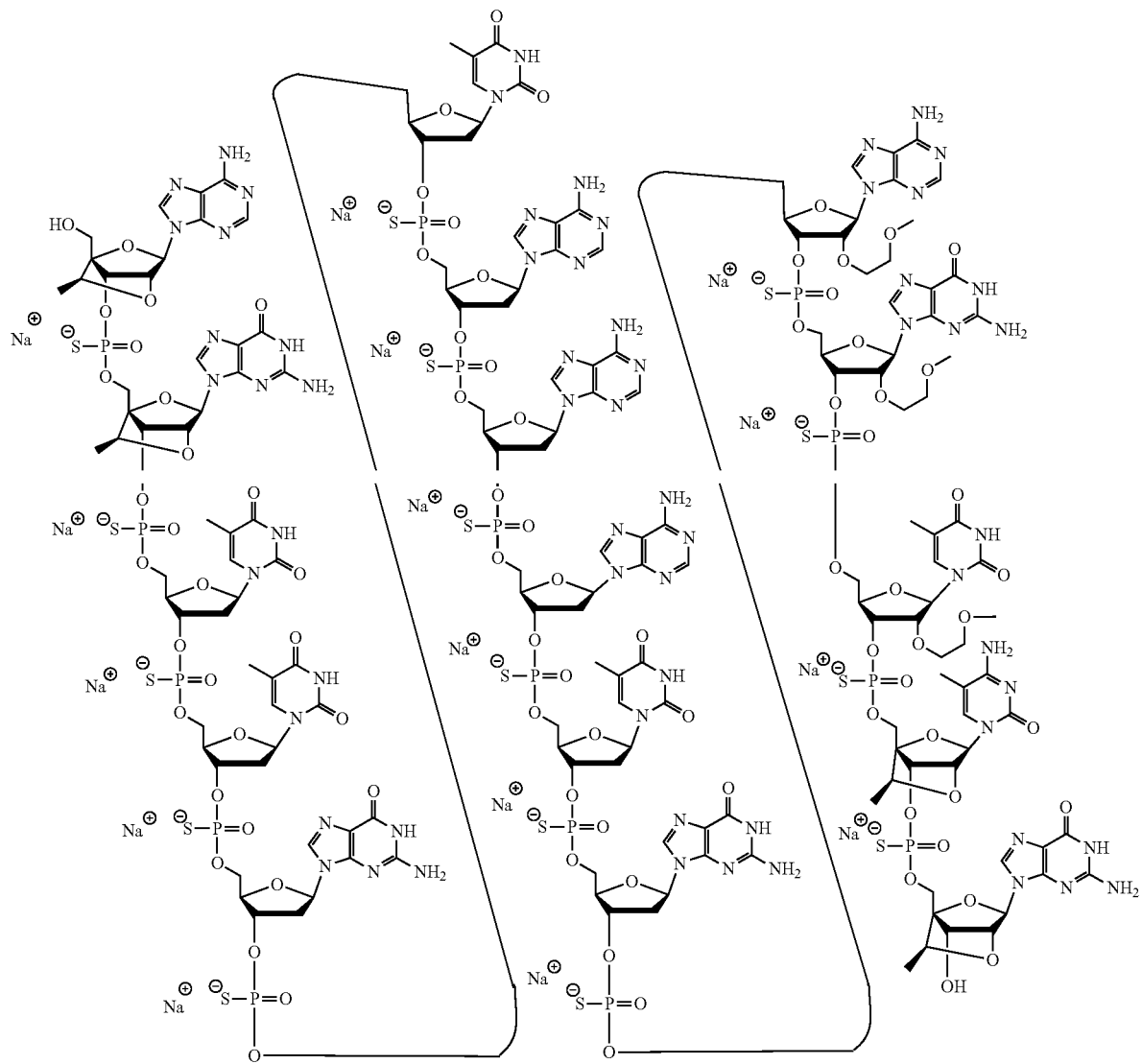

In certain embodiments, a compound comprises or consists of ION 935968 or salt thereof, having the following chemical structure:
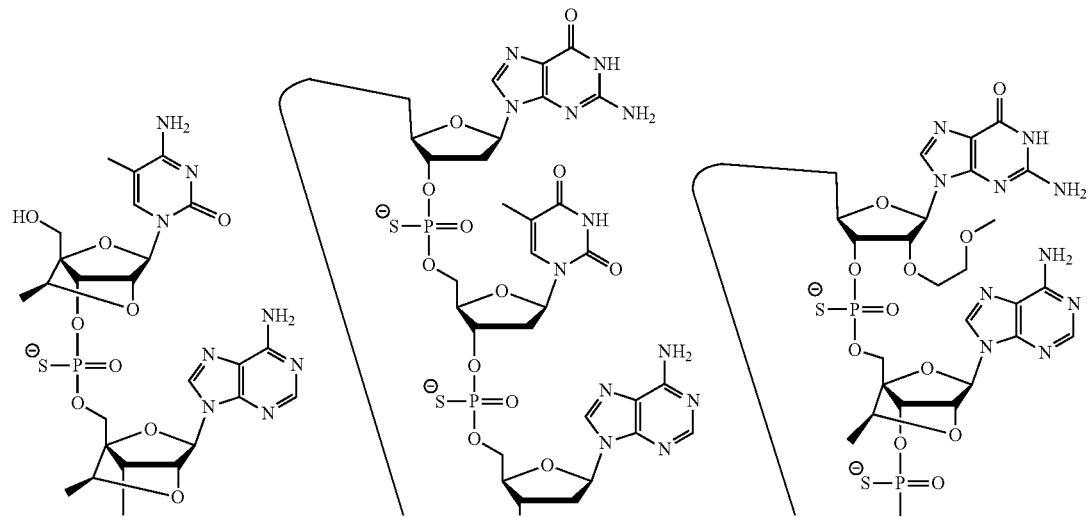
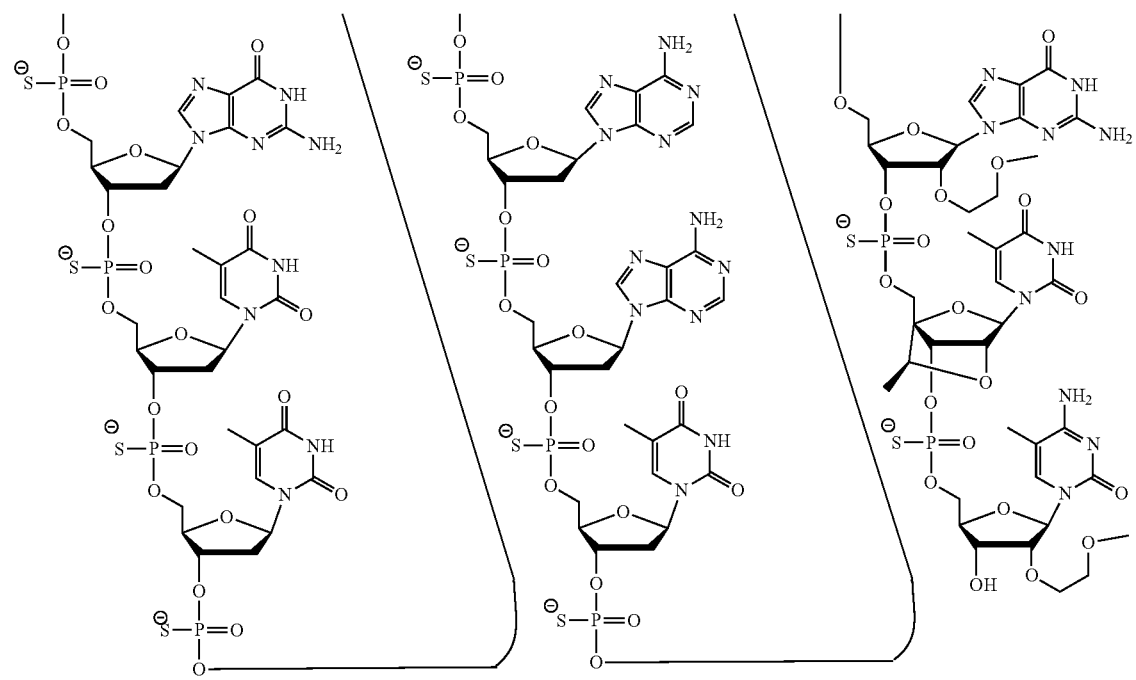

In certain embodiments, a compound comprises or consists of the sodium salt of ION 935968, having the following chemical structure:

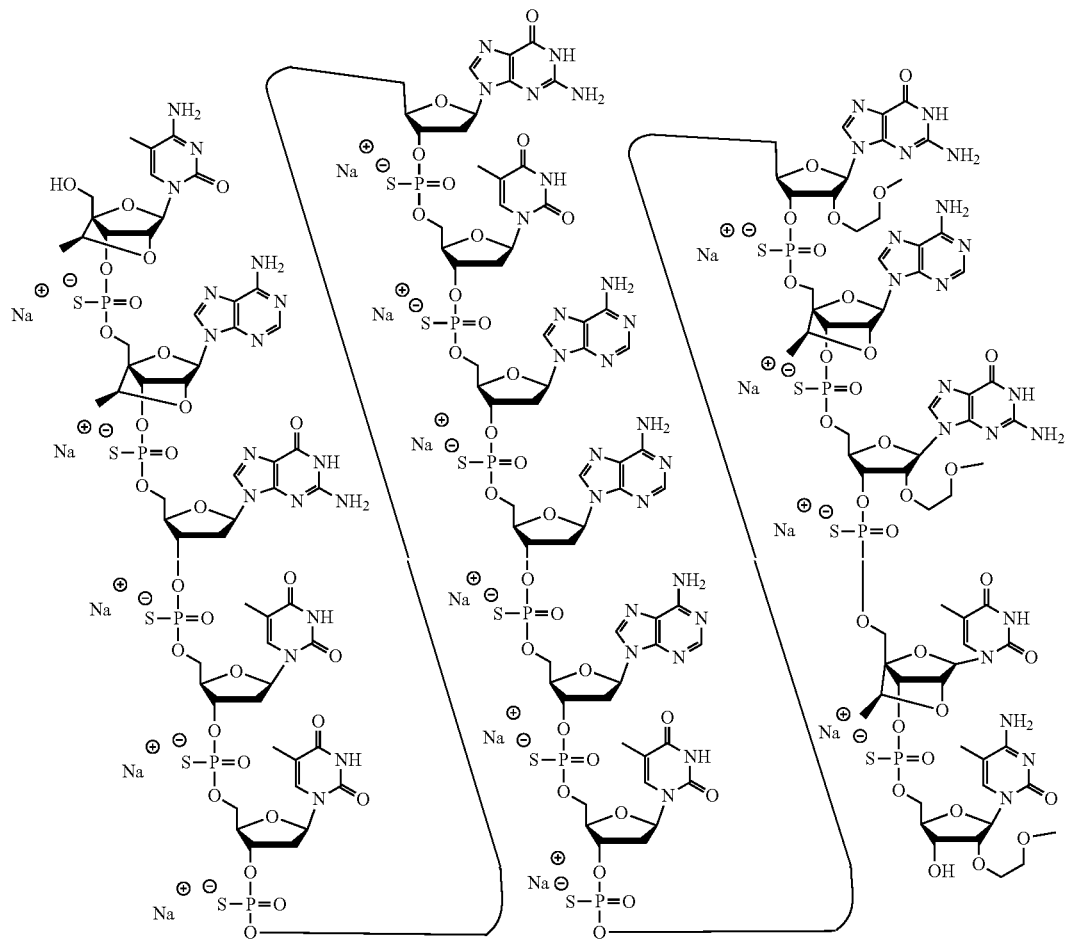

In any of the foregoing embodiments, the compound or oligonucleotide can be at least 85%, at least 90%, at least 95%, at least 98%, at least 99%, or 100% complementary to a nucleic acid encoding IRF4.

In any of the foregoing embodiments, the compound can be single-stranded. In certain embodiments, the compound comprises deoxyribonucleotides. In certain embodiments, the compound is double-stranded. In certain embodiments, the compound is double-stranded and comprises ribonucleotides. In any of the foregoing embodiments, the compound can be an antisense compound or oligomeric compound.

In any of the foregoing embodiments, the compound can be 8 to 80, 10 to 30, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked nucleosides in length. In certain embodiments, the compound comprises or consists of an oligonucleotide.

In certain embodiments, compounds or compositions provided herein comprise a salt of the modified oligonucleotide. In certain embodiments, the salt is a sodium salt. In certain embodiments, the salt is a potassium salt.

In certain embodiments, the compounds or compositions as described herein are highly tolerable as demonstrated by having at least one of an increase an alanine transaminase (ALT) or aspartate transaminase (AST) value of no more than 4 fold, 3 fold, or 2 fold over saline treated animals or an increase in liver, spleen, or kidney weight of no more than 30%, 20%, 15%, 12%, 10%, 5%, or 2% compared to control treated animals. In certain embodiments, the compounds or compositions as described herein are highly tolerable as demonstrated by having no increase of ALT or AST over control treated animals. In certain embodiments, the compounds or compositions as described herein are highly tolerable as demonstrated by having no increase in liver, spleen, or kidney weight over control animals.

Certain embodiments provide a composition comprising the compound of any of the aforementioned embodiments or salt thereof and at least one of a pharmaceutically acceptable carrier or diluent. In certain embodiments, the composition has a viscosity less than about 40 centipoise (cP), less than about 30 centipose (cP), less than about 20 centipose (cP), less than about 15 centipose (cP), or less than about 10 centipose (cP). In certain embodiments, the composition having any of the aforementioned viscosities comprises a compound provided herein at a concentration of about 100 mg/mL, about 125 mg/mL, about 150 mg/mL, about 175 mg/mL, about 200 mg/mL, about 225 mg/mL, about 250 mg/mL, about 275 mg/mL, or about 300 mg/mL. In certain embodiments, the composition having any of the aforementioned viscosities and/or compound concentrations has a temperature of room temperature or about 20° C., about 21° C., about 22° C., about 23° C., about 24° C., about 25° C., about 26° C., about 27° C., about 28° C., about 29° C., or about 30° C.

Certain Indications

Certain embodiments provided herein relate to methods of inhibiting IRF4 expression, which can be useful for treating, preventing, or ameliorating a cancer associated with IRF4 in an individual, by administration of a compound that targets IRF4. In certain embodiments, the compound can be a IRF4 specific inhibitor. In certain embodiments, the compound can be an antisense compound, oligomeric compound, or oligonucleotide targeted to IRF4.

Examples of cancers associated with IRF4 treatable, preventable, and/or ameliorable with the methods provided herein include blood cancer, myeloma, multiple myeloma (MM), B cell malignancies, lymphoma, B cell lymphoma, T cell lymphoma, or leukemia. In certain embodiments, the B-cell lymphoma is a non-Hodgkin's B-cell lymphoma. Examples of non-Hodgkin's B-cell lymphoma of certain embodiments that can be treated with compounds provided herein include, but are not limited to, diffuse large B cell lymphoma (DLBCL), activated B-cell lymphoma (ABC-DLBCL), germinal center B-cell lymphoma (GCB DLBCL), follicular lymphoma, mucosa-associated lymphatic tissue lymphoma (MALT), small cell lymphocytic lymphoma, chronic lymphocytic leukemia, mantle cell lymphoma (MCL), Burkitt lymphoma, mediastinal large B cell lymphoma, Waldenström macroglobulinemia, nodal marginal zone B cell lymphoma (NMZL), splenic marginal zone lymphoma (SMZL), intravascular large B-cell lymphoma, primary effusion lymphoma, and lymphomatoid granulomatosis. In certain embodiments, the T-cell lymphoma that can be treated with compounds provided herein include, but are not limited to, peripheral T-cell lymphoma, adult T cell leukemia/lymphoma (ATLL), and anaplastic large cell lymphoma (ALCL). In certain embodiments, the leukemia that can be treated with compounds provided herein includes, but is not limited to, acute lymphocytic leukemia (ALL).

In certain embodiments, a method of treating, preventing, or ameliorating a cancer associated with IRF4 in an individual comprises administering to the individual a compound comprising a IRF4 specific inhibitor, thereby treating, preventing, or ameliorating the cancer. In certain embodiments, the compound comprises an antisense compound targeted to IRF4. In certain embodiments, the compound comprises an oligonucleotide targeted to IRF4. In certain embodiments, a compound comprises a modified oligonucleotide 8 to 80 linked nucleosides in length and having a nucleobase sequence comprising at least 8 contiguous nucleobases of any of the nucleobase sequences of SEQ ID NOs: 3-3383. In certain embodiments, a compound comprises a modified oligonucleotide 16 to 80 linked nucleosides in length and having a nucleobase sequence comprising the nucleobase sequence of any one of SEQ ID NOs: 3-3383. In certain embodiments, a compound comprises a modified oligonucleotide consisting of the nucleobase sequence of any one of SEQ ID NOs: 3-3383. In certain embodiments, a compound comprises a modified oligonucleotide 16 to 80 linked nucleosides in length having a nucleobase sequence comprising any one of SEQ ID NOs: 2021, 560, 559, 1330, 1540, or 3303. In certain embodiments, a compound comprises a modified oligonucleotide having a nucleobase sequence consisting of any one of SEQ ID NOs: 2021, 560, 559, 1330, 1540, or 3303. In any of the foregoing embodiments, the modified oligonucleotide can be 10 to 30 linked nucleosides in length. In certain embodiments, the compound is ION 690890, 935658, 935696, 935762, 935918, 935968, 882800, 1012795, 1014095, and 1014834. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound inhibits or reduces cancer cell proliferation, tumor growth, or metastasis.

In certain embodiments, a method of treating or ameliorating caner comprises administering to the individual a compound comprising a IRF4 specific inhibitor, thereby treating or ameliorating the cancer. In certain embodiments, the cancer is a blood cancer, myeloma, multiple myeloma (MM), B cell malignancy, lymphoma, B cell lymphoma, T cell lymphoma, or leukemia. In certain embodiments, the B-cell lymphoma is a non-Hodgkin's B-cell lymphoma. Examples of non-Hodgkin's B-cell lymphoma of certain embodiments that can be treated with compounds provided herein include, but are not limited to, diffuse large B cell lymphoma (DLBCL), activated B-cell lymphoma (ABC-DLBCL), germinal center B-cell lymphoma (GCB DLBCL), follicular lymphoma, mucosa-associated lymphatic tissue lymphoma (MALT), small cell lymphocytic lymphoma, chronic lymphocytic leukemia, mantle cell lymphoma (MCL), Burkitt lymphoma, mediastinal large B cell lymphoma, Waldenström macroglobulinemia, nodal marginal zone B cell lymphoma (NMZL), splenic marginal zone lymphoma (SMZL), intravascular large B-cell lymphoma, primary effusion lymphoma, and lymphomatoid granulomatosis. In certain embodiments, the T-cell lymphoma that can be treated with compounds provided herein include, but are not limited to, peripheral T-cell lymphoma, adult T cell leukemia/lymphoma (ATLL), and anaplastic large cell lymphoma (ALCL). In certain embodiments, the leukemia that can be treated with compounds provided herein includes, but is not limited to, acute lymphocytic leukemia (ALL). In certain embodiments, the compound comprises an antisense compound targeted to IRF4. In certain embodiments, the compound comprises an oligonucleotide targeted to IRF4. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 3-3383. In certain embodiments, the compound comprises a modified oligonucleotide 16 to 80 linked nucleosides in length and having a nucleobase sequence comprising the nucleobase sequence of any one of SEQ ID NOs: 3-3383. In certain embodiments, the compound comprises a modified oligonucleotide consisting of the nucleobase sequence of any one of SEQ ID NOs: 3-3383. In certain embodiments, the compound comprises a modified oligonucleotide of 16 to 80 linked nucleosides in length having a nucleobase sequence comprising any one of SEQ ID NOs: 2021, 560, 559, 1330, 1540, or 3303. In certain embodiments, the compound comprises a modified oligonucleotide having a nucleobase sequence consisting of any one of SEQ ID NOs: 2021, 560, 559, 1330, 1540, or 3303. In any of the foregoing embodiments, the modified oligonucleotide can be 10 to 30 linked nucleosides in length. In certain embodiments, the compound is ION 690890, 935658, 935696, 935762, 935918, 935968, 882800, 1012795, 1014095, and 1014834. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound inhibits or reduces cancer cell proliferation, tumor growth, or metastasis. In certain embodiments, the individual is identified as having or at risk of having a cancer associated with IRF4.

In certain embodiments, a method of inhibiting expression of IRF4 in an individual having, or at risk of having, a cancer associated with IRF4 comprises administering to the individual a compound comprising a IRF4 specific inhibitor, thereby inhibiting expression of IRF4 in the individual. In certain embodiments, administering the compound inhibits expression of IRF4 in the bone marrow, lymphoid tissue, or lymph node. In certain embodiments, the individual has, or is at risk of having blood cancer, myeloma, multiple myeloma (MM), B cell malignancies, lymphoma, B cell lymphoma, T cell lymphoma, or leukemia. In certain embodiments, the B-cell lymphoma is a non-Hodgkin's B-cell lymphoma. Examples of non-Hodgkin's B-cell lymphoma of certain embodiments that can be treated with compounds provided herein include, but are not limited to, diffuse large B cell lymphoma (DLBCL), activated B-cell lymphoma (ABC-DLBCL), germinal center B-cell lymphoma (GCB DLBCL), follicular lymphoma, mucosa-associated lymphatic tissue lymphoma (MALT), small cell lymphocytic lymphoma, chronic lymphocytic leukemia, mantle cell lymphoma (MCL), Burkitt lymphoma, mediastinal large B cell lymphoma, Waldenström macroglobulinemia, nodal marginal zone B cell lymphoma (NMZL), splenic marginal zone lymphoma (SMZL), intravascular large B-cell lymphoma, primary effusion lymphoma, and lymphomatoid granulomatosis. In certain embodiments, the T-cell lymphoma that can be treated with compounds provided herein include, but are not limited to, peripheral T-cell lymphoma, adult T cell leukemia/lymphoma (ATLL), and anaplastic large cell lymphoma (ALCL). In certain embodiments, the leukemia that can be treated with compounds provided herein includes, but is not limited to, acute lymphocytic leukemia (ALL). In certain embodiments, the compound comprises an antisense compound targeted to IRF4. In certain embodiments, the compound comprises an oligonucleotide targeted to IRF4. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 3-3383. In certain embodiments, the compound comprises a modified oligonucleotide 16 to 80 linked nucleosides in length and having a nucleobase sequence comprising the nucleobase sequence of any one of SEQ ID NOs: 3-3383. In certain embodiments, the compound comprises a modified oligonucleotide consisting of the nucleobase sequence of any one of SEQ ID NOs: 3-3383. In certain embodiments, the compound comprises a modified oligonucleotide of 16 to 80 linked nucleosides in length having a nucleobase sequence comprising any one of SEQ ID NOs: 2021, 560, 559, 1330, 1540, or 3303. In certain embodiments, the compound comprises a modified oligonucleotide having a nucleobase sequence consisting of any one of SEQ ID NOs: 2021, 560, 559, 1330, 1540, or 3303. In any of the foregoing embodiments, the modified oligonucleotide can be 10 to 30 linked nucleosides in length. In certain embodiments, the compound is ION 690890, 935658, 935696, 935762, 935918, 935968, 882800, 1012795, 1014095, and 1014834. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound inhibits or reduces cancer cell proliferation, tumor growth, or metastasis. In certain embodiments, the individual is identified as having or at risk of having a cancer associated with IRF4.

In certain embodiments, a method of inhibiting expression of IRF4 in a cell comprises contacting the cell with a compound comprising a IRF4 specific inhibitor, thereby inhibiting expression of IRF4 in the cell. In certain embodiments, the cell is a cancer cell. In certain embodiments, the cell is a bone marrow, lymphoid tissue, or lymph node cell. In certain embodiments, the cell is in the bone marrow, lymphoid tissue, or lymph node. In certain embodiments, the cell is in the bone marrow, lymphoid tissue, or lymph node of an individual who has, or is at risk of having cancer, such as blood cancer, myeloma, multiple myeloma (MM), B cell malignancies, lymphoma, B cell lymphoma, T cell lymphoma, or leukemia. In certain embodiments, the compound comprises an antisense compound targeted to IRF4. In certain embodiments, the compound comprises an oligonucleotide targeted to IRF4. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 3-3383. In certain embodiments, the compound comprises a modified oligonucleotide 16 to 80 linked nucleosides in length and having a nucleobase sequence comprising the nucleobase sequence of any one of SEQ ID NOs: 3-3383. In certain embodiments, the compound comprises a modified oligonucleotide consisting of the nucleobase sequence of any one of SEQ ID NOs: 3-3383. In certain embodiments, the compound comprises a modified oligonucleotide of 16 to 80 linked nucleosides in length having a nucleobase sequence comprising any one of SEQ ID NOs: 2021, 560, 559, 1330, 1540, or 3303. In certain embodiments, the compound comprises a modified oligonucleotide having a nucleobase sequence consisting of any one of SEQ ID NOs: 2021, 560, 559, 1330, 1540, or 3303. In any of the foregoing embodiments, the modified oligonucleotide can be 10 to 30 linked nucleosides in length. In certain embodiments, the compound is ION 690890, 935658, 935696, 935762, 935918, 935968, 882800, 1012795, 1014095, and 1014834. In any of the foregoing embodiments, the compound can be single-stranded or double-stranded. In any of the foregoing embodiments, the compound can be an antisense compound or oligomeric compound.

In certain embodiments, a method of reducing or inhibiting cancer cell proliferation, tumor growth, or metastasis of an individual having, or at risk of having, a cancer associated with IRF4 comprises administering to the individual a compound comprising a IRF4 specific inhibitor, thereby reducing or inhibiting cancer cell proliferation, tumor growth, or metastasis in the individual. In certain embodiments, the individual has, or is at risk of having, blood cancer, myeloma, multiple myeloma (MM), B cell malignancies, lymphoma, B cell lymphoma, T cell lymphoma, or leukemia. Examples of cancers associated with IRF4 treatable, preventable, and/or ameliorable with the methods provided herein include blood cancer, myeloma, multiple myeloma (MM), B cell malignancies, lymphoma, B cell lymphoma, T cell lymphoma, or leukemia. In certain embodiments, the B-cell lymphoma is a non-Hodgkin's B-cell lymphoma. Examples of non-Hodgkin's B-cell lymphoma of certain embodiments that can be treated with compounds provided herein include, but are not limited to, diffuse large B cell lymphoma (DLBCL), activated B-cell lymphoma (ABC-DLBCL), germinal center B-cell lymphoma (GCB DLBCL), follicular lymphoma, mucosa-associated lymphatic tissue lymphoma (MALT), small cell lymphocytic lymphoma, chronic lymphocytic leukemia, mantle cell lymphoma (MCL), Burkitt lymphoma, mediastinal large B cell lymphoma, Waldenström macroglobulinemia, nodal marginal zone B cell lymphoma (NMZL), splenic marginal zone lymphoma (SMZL), intravascular large B-cell lymphoma, primary effusion lymphoma, and lymphomatoid granulomatosis. In certain embodiments, the T-cell lymphoma that can be treated with compounds provided herein include, but are not limited to, peripheral T-cell lymphoma, adult T cell leukemia/lymphoma (ATLL), and anaplastic large cell lymphoma (ALCL). In certain embodiments, the leukemia that can be treated with compounds provided herein includes, but is not limited to, acute lymphocytic leukemia (ALL). In certain embodiments, the compound comprises an antisense compound targeted to IRF4. In certain embodiments, the compound comprises an oligonucleotide targeted to IRF4. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 3-3383. In certain embodiments, the compound comprises a modified oligonucleotide 16 to 80 linked nucleosides in length and having a nucleobase sequence comprising the nucleobase sequence of any one of SEQ ID NOs: 3-3383. In certain embodiments, the compound comprises a modified oligonucleotide consisting of the nucleobase sequence of any one of SEQ ID NOs: 3-3383. In certain embodiments, the compound comprises a modified oligonucleotide of 16 to 80 linked nucleosides in length having a nucleobase sequence comprising any one of SEQ ID NOs: 2021, 560, 559, 1330, 1540, or 3303. In certain embodiments, the compound comprises a modified oligonucleotide having a nucleobase sequence consisting of any one of SEQ ID NOs: 2021, 560, 559, 1330, 1540, or 3303. In any of the foregoing embodiments, the modified oligonucleotide can be 10 to 30 linked nucleosides in length. In certain embodiments, the compound is ION 690890, 935658, 935696, 935762, 935918, 935968, 882800, 1012795, 1014095, and 1014834. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, the individual is identified as having or at risk of having a cancer associated with IRF4.

Certain embodiments are drawn to a compound comprising a IRF4 specific inhibitor for use in treating cancer. In certain embodiments, the cancer is a blood cancer, myeloma, multiple myeloma (MM), B cell malignancy, lymphoma, B cell lymphoma, T cell lymphoma, or leukemia. In certain embodiments, the B-cell lymphoma is a non-Hodgkin's B-cell lymphoma. Examples of non-Hodgkin's B-cell lymphoma of certain embodiments that can be treated with compounds provided herein include, but are not limited to, diffuse large B cell lymphoma (DLBCL), activated B-cell lymphoma (ABC-DLBCL), germinal center B-cell lymphoma (GCB DLBCL), follicular lymphoma, mucosa-associated lymphatic tissue lymphoma (MALT), small cell lymphocytic lymphoma, chronic lymphocytic leukemia, mantle cell lymphoma (MCL), Burkitt lymphoma, mediastinal large B cell lymphoma, Waldenström macroglobulinemia, nodal marginal zone B cell lymphoma (NMZL), splenic marginal zone lymphoma (SMZL), intravascular large B-cell lymphoma, primary effusion lymphoma, and lymphomatoid granulomatosis. In certain embodiments, the T-cell lymphoma that can be treated with compounds provided herein include, but are not limited to, peripheral T-cell lymphoma, adult T cell leukemia/lymphoma (ATLL), and anaplastic large cell lymphoma (ALCL). In certain embodiments, the leukemia that can be treated with compounds provided herein includes, but is not limited to, acute lymphocytic leukemia (ALL). In certain embodiments, the compound comprises an antisense compound targeted to IRF4. In certain embodiments, the compound comprises an oligonucleotide targeted to IRF4. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 3-3383. In certain embodiments, the compound comprises a modified oligonucleotide 16 to 80 linked nucleosides in length and having a nucleobase sequence comprising the nucleobase sequence of any one of SEQ ID NOs: 3-3383. In certain embodiments, the compound comprises a modified oligonucleotide consisting of the nucleobase sequence of any one of SEQ ID NOs: 3-3383. In certain embodiments, the compound comprises a modified oligonucleotide of 16 to 80 linked nucleosides in length having a nucleobase sequence comprising any one of SEQ ID NOs: 2021, 560, 559, 1330, 1540, or 3303. In certain embodiments, the compound comprises a modified oligonucleotide having a nucleobase sequence consisting of any one of SEQ ID NOs: 2021, 560, 559, 1330, 1540, or 3303. In any of the foregoing embodiments, the modified oligonucleotide can be 10 to 30 linked nucleosides in length. In certain embodiments, the compound is ION 690890, 935658, 935696, 935762, 935918, 935968, 882800, 1012795, 1014095, and 1014834. In any of the foregoing embodiments, the compound can be single-stranded or double-stranded. In any of the foregoing embodiments, the compound can be an antisense compound or oligomeric compound.

Certain embodiments are drawn to a compound comprising a IRF4 specific inhibitor for use in reducing or inhibiting cancer cell proliferation, tumor growth, or metastasis in an individual having cancer. In certain embodiments, the cancer is a blood cancer, myeloma, multiple myeloma (MM), B cell malignancy, lymphoma, B cell lymphoma, T cell lymphoma, or leukemia. In certain embodiments, the compound comprises an antisense compound targeted to IRF4. In certain embodiments, the compound comprises an oligonucleotide targeted to IRF4. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 3-3383. In certain embodiments, the compound comprises a modified oligonucleotide 16 to 80 linked nucleosides in length and having a nucleobase sequence comprising the nucleobase sequence of any one of SEQ ID NOs: 3-3383. In certain embodiments, the compound comprises a modified oligonucleotide consisting of the nucleobase sequence of any one of SEQ ID NOs: 3-3383. In certain embodiments, the compound comprises a modified oligonucleotide of 16 to 80 linked nucleosides in length having a nucleobase sequence comprising any one of SEQ ID NOs: 2021, 560, 559, 1330, 1540, or 3303. In certain embodiments, the compound comprises a modified oligonucleotide having a nucleobase sequence consisting of any one of SEQ ID NOs: 2021, 560, 559, 1330, 1540, or 3303. In any of the foregoing embodiments, the modified oligonucleotide can be 10 to 30 linked nucleosides in length. In certain embodiments, the compound is ION 690890, 935658, 935696, 935762, 935918, 935968, 882800, 1012795, 1014095, and 1014834. In any of the foregoing embodiments, the compound can be single-stranded or double-stranded. In any of the foregoing embodiments, the compound can be an antisense compound or oligomeric compound.

Certain embodiments are drawn to use of a compound comprising a IRF4 specific inhibitor for the manufacture or preparation of a medicament for treating cancer. Certain embodiments are drawn to use of a compound comprising a IRF4 specific inhibitor for the preparation of a medicament for treating a cancer associated with IRF4. In certain embodiments, the cancer is a blood cancer, myeloma, multiple myeloma (MM), B cell malignancy, lymphoma, B cell lymphoma, T cell lymphoma, or leukemia. In certain embodiments, the B-cell lymphoma is a non-Hodgkin's B-cell lymphoma. Examples of non-Hodgkin's B-cell lymphoma of certain embodiments that can be treated with compounds provided herein include, but are not limited to, diffuse large B cell lymphoma (DLBCL), activated B-cell lymphoma (ABC-DLBCL), germinal center B-cell lymphoma (GCB DLBCL), follicular lymphoma, mucosa-associated lymphatic tissue lymphoma (MALT), small cell lymphocytic lymphoma, chronic lymphocytic leukemia, mantle cell lymphoma (MCL), Burkitt lymphoma, mediastinal large B cell lymphoma, Waldenström macroglobulinemia, nodal marginal zone B cell lymphoma (NMZL), splenic marginal zone lymphoma (SMZL), intravascular large B-cell lymphoma, primary effusion lymphoma, and lymphomatoid granulomatosis. In certain embodiments, the T-cell lymphoma that can be treated with compounds provided herein include, but are not limited to, peripheral T-cell lymphoma, adult T cell leukemia/lymphoma (ATLL), and anaplastic large cell lymphoma (ALCL). In certain embodiments, the leukemia that can be treated with compounds provided herein includes, but is not limited to, acute lymphocytic leukemia (ALL). In certain embodiments, the compound comprises an antisense compound targeted to IRF4. In certain embodiments, the compound comprises an oligonucleotide targeted to IRF4. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 3-3383. In certain embodiments, the compound comprises a modified oligonucleotide 16 to 80 linked nucleosides in length and having a nucleobase sequence comprising the nucleobase sequence of any one of SEQ ID NOs: 3-3383. In certain embodiments, the compound comprises a modified oligonucleotide consisting of the nucleobase sequence of any one of SEQ ID NOs: 3-3383. In certain embodiments, the compound comprises a modified oligonucleotide of 16 to 80 linked nucleosides in length having a nucleobase sequence comprising any one of SEQ ID NOs: 2021, 560, 559, 1330, 1540, or 3303. In certain embodiments, the compound comprises a modified oligonucleotide having a nucleobase sequence consisting of any one of SEQ ID NOs: 2021, 560, 559, 1330, 1540, or 3303. In any of the foregoing embodiments, the modified oligonucleotide can be 10 to 30 linked nucleosides in length. In certain embodiments, the compound is ION 690890, 935658, 935696, 935762, 935918, 935968, 882800, 1012795, 1014095, and 1014834. In any of the foregoing embodiments, the compound can be single-stranded or double-stranded. In any of the foregoing embodiments, the compound can be an antisense compound or oligomeric compound.

Certain embodiments are drawn to use of a compound comprising a IRF4 specific inhibitor for the manufacture or preparation of a medicament for reducing or inhibiting cancer cell proliferation, tumor growth, or metastasis in an individual having cancer. In certain embodiments, the cancer is a blood cancer, myeloma, multiple myeloma (MM), B cell malignancy, lymphoma, B cell lymphoma, T cell lymphoma, or leukemia. Certain embodiments are drawn to use of a compound comprising a IRF4 specific inhibitor for the preparation of a medicament for reducing or inhibiting cancer cell proliferation, tumor growth, or metastasis in an individual having cancer. In certain embodiments, the cancer is a blood cancer, myeloma, multiple myeloma (MM), B cell malignancy, lymphoma, B cell lymphoma, T cell lymphoma, or leukemia. In certain embodiments, the B-cell lymphoma is a non-Hodgkin's B-cell lymphoma. Examples of non-Hodgkin's B-cell lymphoma of certain embodiments include, but are not limited to, diffuse large B cell lymphoma (DLBCL), activated B-cell lymphoma (ABC-DLBCL), germinal center B-cell lymphoma (GCB DLBCL), follicular lymphoma, mucosa-associated lymphatic tissue lymphoma (MALT), small cell lymphocytic lymphoma, chronic lymphocytic leukemia, mantle cell lymphoma (MCL), Burkitt lymphoma, mediastinal large B cell lymphoma, Waldenström macroglobulinemia, nodal marginal zone B cell lymphoma (NMZL), splenic marginal zone lymphoma (SMZL), intravascular large B-cell lymphoma, primary effusion lymphoma, and lymphomatoid granulomatosis. In certain embodiments, the T-cell lymphoma includes, but is not limited to, peripheral T-cell lymphoma, adult T cell leukemia/lymphoma (ATLL), and anaplastic large cell lymphoma (ALCL). In certain embodiments, the leukemia includes, but is not limited to, acute lymphocytic leukemia (ALL). In certain embodiments, the compound comprises an antisense compound targeted to IRF4. In certain embodiments, the compound comprises an oligonucleotide targeted to IRF4. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 3-3383. In certain embodiments, the compound comprises a modified oligonucleotide 16 to 80 linked nucleosides in length and having a nucleobase sequence comprising the nucleobase sequence of any one of SEQ ID NOs: 3-3383. In certain embodiments, the compound comprises a modified oligonucleotide consisting of the nucleobase sequence of any one of SEQ ID NOs: 3-3383. In certain embodiments, the compound comprises a modified oligonucleotide of 16 to 80 linked nucleosides in length having a nucleobase sequence comprising any one of SEQ ID NOs: 2021, 560, 559, 1330, 1540, or 3303. In certain embodiments, the compound comprises a modified oligonucleotide having a nucleobase sequence consisting of any one of SEQ ID NOs: 2021, 560, 559, 1330, 1540, or 3303. In any of the foregoing embodiments, the modified oligonucleotide can be 10 to 30 linked nucleosides in length. In certain embodiments, the compound is ION 690890, 935658, 935696, 935762, 935918, 935968, 882800, 1012795, 1014095, and 1014834. In any of the foregoing embodiments, the compound can be single-stranded or double-stranded. In any of the foregoing embodiments, the compound can be an antisense compound or oligomeric compound.

In any of the foregoing methods or uses, the compound can be targeted to IRF4. In certain embodiments, the compound comprises or consists of a modified oligonucleotide, for example a modified oligonucleotide 8 to 80 linked nucleosides in length, 10 to 30 linked nucleosides in length, 12 to 30 linked nucleosides in length, or 20 linked nucleosides in length. In certain embodiments, the modified oligonucleotide is at least 80%, 85%, 90%, 95% or 100% complementary to any of the nucleobase sequences recited in SEQ ID NOs: 1-2. In certain embodiments, the modified oligonucleotide comprises at least one modified internucleoside linkage, at least one modified sugar and/or at least one modified nucleobase. In certain embodiments, the modified internucleoside linkage is a phosphorothioate internucleoside linkage, the modified sugar is a bicyclic sugar or a 2'-O-methoxyethyl, and the modified nucleobase is a 5-methylcytosine. In certain embodiments, the modified oligonucleotide comprises a gap segment consisting of linked deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing embodiments, the modified oligonucleotide can be 12 to 30, 15 to 30, 15 to 25, 15 to 24, 16 to 24, 17 to 24, 18 to 24, 19 to 24, 20 to 24, 19 to 22, 20 to 22, 16 to 20, or 17 or 20 linked nucleosides in length. In certain embodiments, the modified oligonucleotide is at least 80%, 85%, 90%, 95% or 100% complementary to any of the nucleobase sequences recited in SEQ ID NOs: 1-2. In certain embodiments, the modified oligonucleotide comprises at least one modified internucleoside linkage, at least one modified sugar and/or at least one modified nucleobase. In certain embodiments, the modified internucleoside linkage is a phosphorothioate internucleoside linkage, the modified sugar is a bicyclic sugar or a 2'-O-methoxyethyl, and the modified nucleobase is a 5-methylcytosine. In certain embodiments, the modified oligonucleotide comprises a gap segment consisting of linked 2'-deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing methods or uses, the compound can comprise or consist of a modified oligonucleotide 16 to 80 linked nucleosides in length and having a nucleobase sequence comprising any one of SEQ ID NOs: 3-3383, wherein the modified oligonucleotide comprises:

a gap segment consisting of linked 2'-deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar. In certain embodiments, the modified oligonucleotide is 16-30 linked nucleosides in length. In certain embodiments, the modified oligonucleotide is 16 linked nucleosides in length.

In any of the foregoing methods or uses, the compound can comprise or consist of a modified oligonucleotide 16-80 linked nucleobases in length having a nucleobase sequence comprising the sequence recited in any one of SEQ ID NOs: 2021, 560, 559, 1330, 1540, or 3303, wherein the modified oligonucleotide comprises:

a gap segment consisting of linked deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar. In certain embodiments, the modified oligonucleotide is 16-30 linked nucleosides in length. In certain embodiments, the modified oligonucleotide is 16 linked nucleosides in length.

In any of the foregoing methods or uses, the compound can comprise or consist of a modified oligonucleotide 16-80 linked nucleobases in length having a nucleobase sequence comprising the sequence recited in any one of SEQ ID NOs: 1330 or 3303, wherein the modified oligonucleotide comprises:

a gap segment consisting of ten linked deoxynucleosides;
a 5' wing segment consisting of three linked nucleosides; and
a 3' wing segment consisting of three linked nucleosides;
wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In any of the foregoing methods or uses, the compound can comprise or consist of a modified oligonucleotide 16-80 linked nucleobases in length having a nucleobase sequence comprising the sequence recited in any one of SEQ ID NOs: 559 or 560, wherein the modified oligonucleotide comprises:

a gap segment consisting of ten linked deoxynucleosides;
a 5' wing segment consisting of one linked nucleoside; and
a 3' wing segment consisting of five linked nucleosides;
wherein the gap segment is positioned between the 5' wing segment and the 3' wing segment; wherein the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In any of the foregoing methods or uses, the compound can comprise or consist of a modified oligonucleotide 16-80 linked nucleobases in length having a nucleobase sequence comprising the sequence recited in any one of SEQ ID NOs: 1330 or 2021, wherein the modified oligonucleotide comprises:

a gap segment consisting of ten linked deoxynucleosides;
a 5' wing segment consisting of two linked nucleosides; and
a 3' wing segment consisting of four linked nucleosides;
wherein the gap segment is positioned between the 5' wing segment and the 3' wing segment; wherein each nucleoside of the 5' wing segment comprises a cEt nucleoside; wherein the 3' wing segment comprises a cEt nucleoside, a 2'-O-methoxyethyl nucleoside, a cEt nucleoside, and a 2'-O-methoxyethyl nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In any of the foregoing methods or uses, the compound can comprise or consist of a modified oligonucleotide 16-80 linked nucleobases in length having a nucleobase sequence comprising the sequence recited in SEQ ID NO: 560, wherein the modified oligonucleotide comprises:

a gap segment consisting of nine linked deoxynucleosides;
a 5' wing segment consisting of two linked nucleosides; and
a 3' wing segment consisting of five linked nucleosides;
wherein the gap segment is positioned between the 5' wing segment and the 3' wing segment; wherein each nucleoside of the 5' wing segment comprises a cEt nucleoside; wherein the 3' wing segment comprises a cEt nucleoside, a 2'-O-methoxyethyl nucleoside, a cEt nucleoside, a 2'-O-methoxyethyl nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In any of the foregoing methods or uses, the compound can comprise or consist of a modified oligonucleotide 16-80 linked nucleobases in length having a nucleobase sequence comprising the sequence recited in SEQ ID NOs: 2021, wherein the modified oligonucleotide comprises:

a gap segment consisting of nine linked deoxynucleosides;

a 5' wing segment consisting of two linked nucleosides; and a 3' wing segment consisting of five linked nucleosides;

wherein the gap segment is positioned between the 5' wing segment and the 3' wing segment; wherein each nucleoside of the 5' wing segment comprises a cEt nucleoside; wherein the 3' wing segment comprises a 2'-O-methoxyethyl nucleoside, a 2'-O-methoxyethyl nucleoside, a 2'-O-methoxyethyl nucleoside, a cEt nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In any of the foregoing methods or uses, the compound can comprise or consist of a modified oligonucleotide 16-80 linked nucleobases in length having a nucleobase sequence comprising the sequence recited in SEQ ID NOs: 1540, wherein the modified oligonucleotide comprises:

a gap segment consisting of nine linked deoxynucleosides;

a 5' wing segment consisting of two linked nucleosides; and a 3' wing segment consisting of five linked nucleosides;

wherein the gap segment is positioned between the 5' wing segment and the 3' wing segment; wherein each nucleoside of the 5' wing segment comprises a cEt nucleoside; wherein the 3' wing segment comprises a 2'-O-methoxyethyl nucleoside, a 2'-O-methoxyethyl nucleoside, a 2'-O-methoxyethyl nucleoside, a cEt nucleoside, and a cEt nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In any of the foregoing methods or uses, the compound can comprise or consist of a modified oligonucleotide 16-80 linked nucleobases in length having a nucleobase sequence comprising the sequence recited in SEQ ID NOs: 560, wherein the modified oligonucleotide comprises:

a gap segment consisting of nine linked deoxynucleosides;

a 5' wing segment consisting of two linked nucleosides; and a 3' wing segment consisting of five linked nucleosides;

wherein the gap segment is positioned between the 5' wing segment and the 3' wing segment; wherein each nucleoside of the 5' wing segment comprises a cEt nucleoside; wherein the 3' wing segment comprises a 2'-O-methoxyethyl nucleoside, a cEt nucleoside, a 2'-O-methoxyethyl nucleoside, a cEt nucleoside, and a 2'-O-methoxyethyl nucleoside in the 5' to 3' direction; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In any of the foregoing methods or uses, the compound can comprise or consist of ION 935918 or salt thereof, having the following chemical structure:

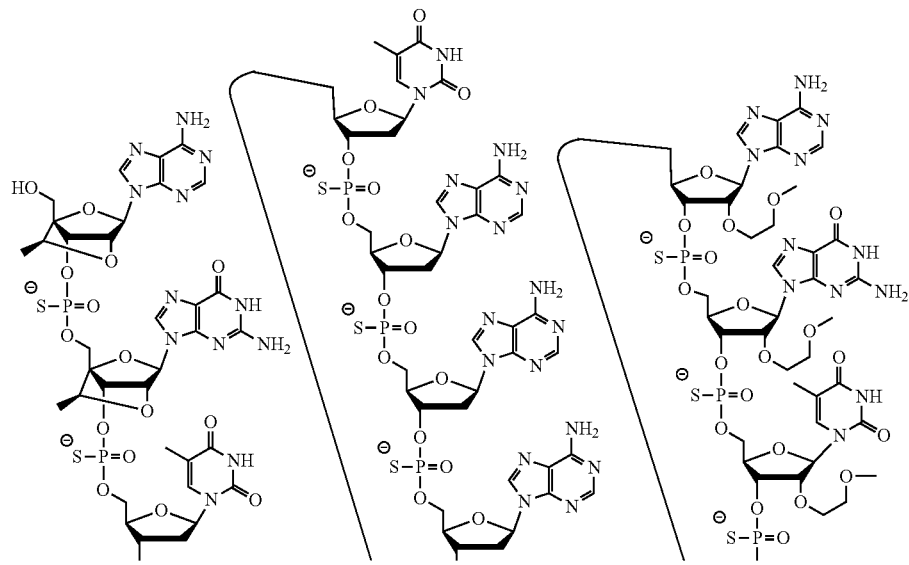

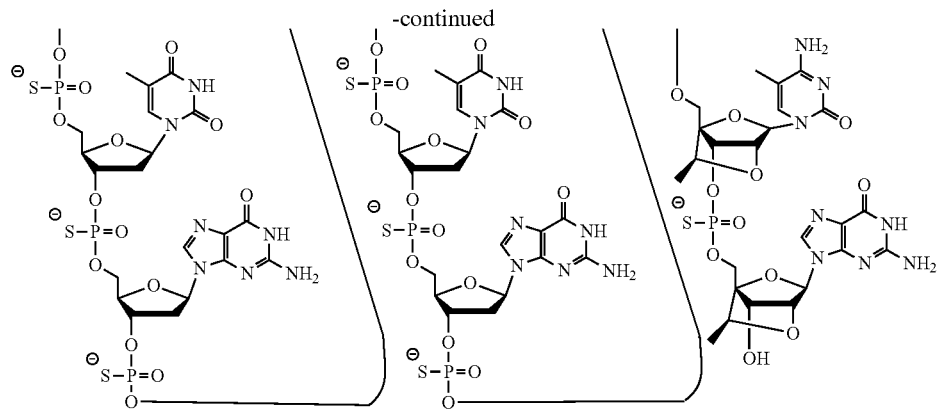
In any of the foregoing methods or uses, the compound can comprise or consist of the sodium salt of ION 935918, having the following chemical structure:
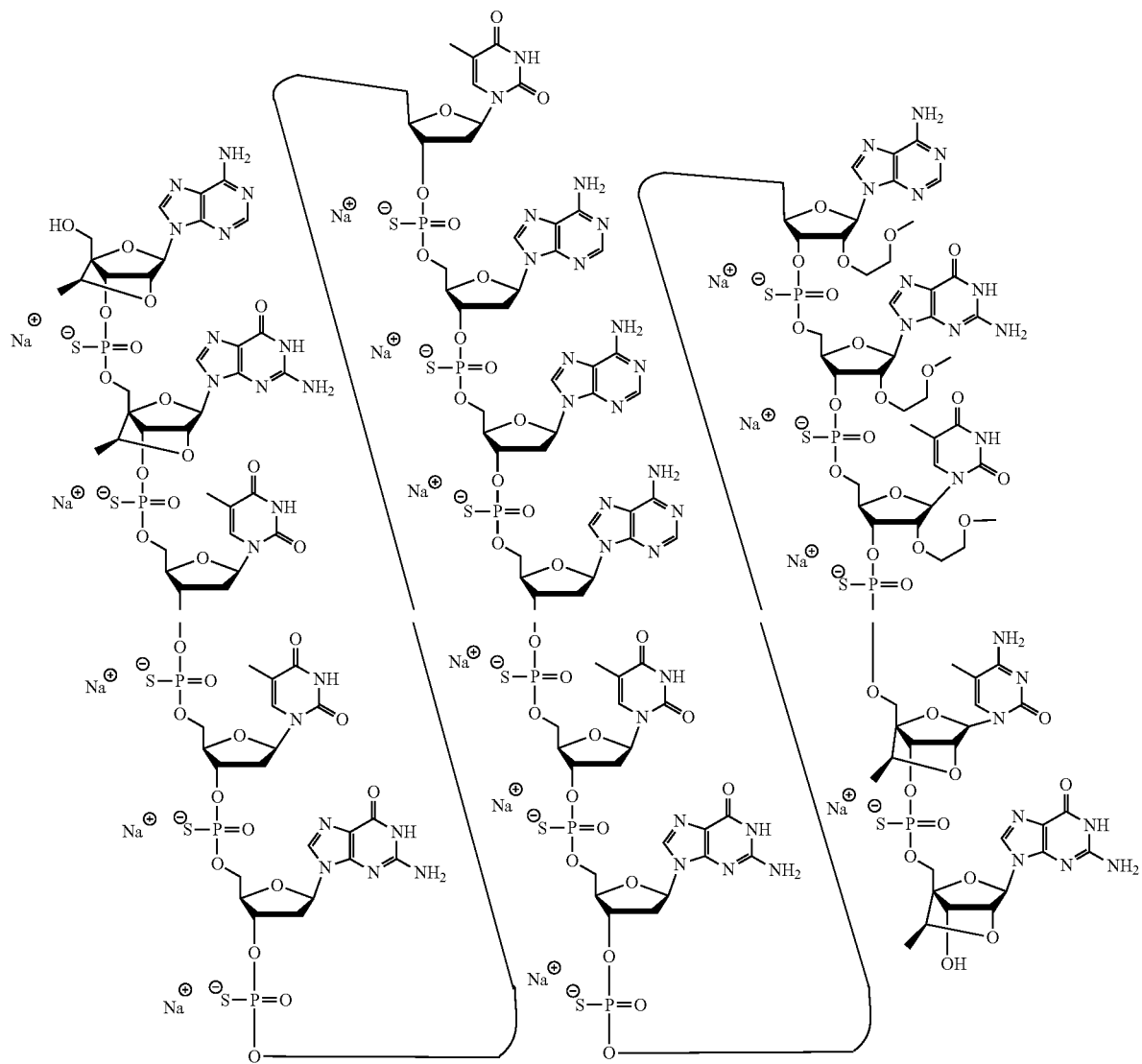

In any of the foregoing methods or uses, the compound can comprise or consist of ION 935968 or salt thereof, having the following chemical structure:
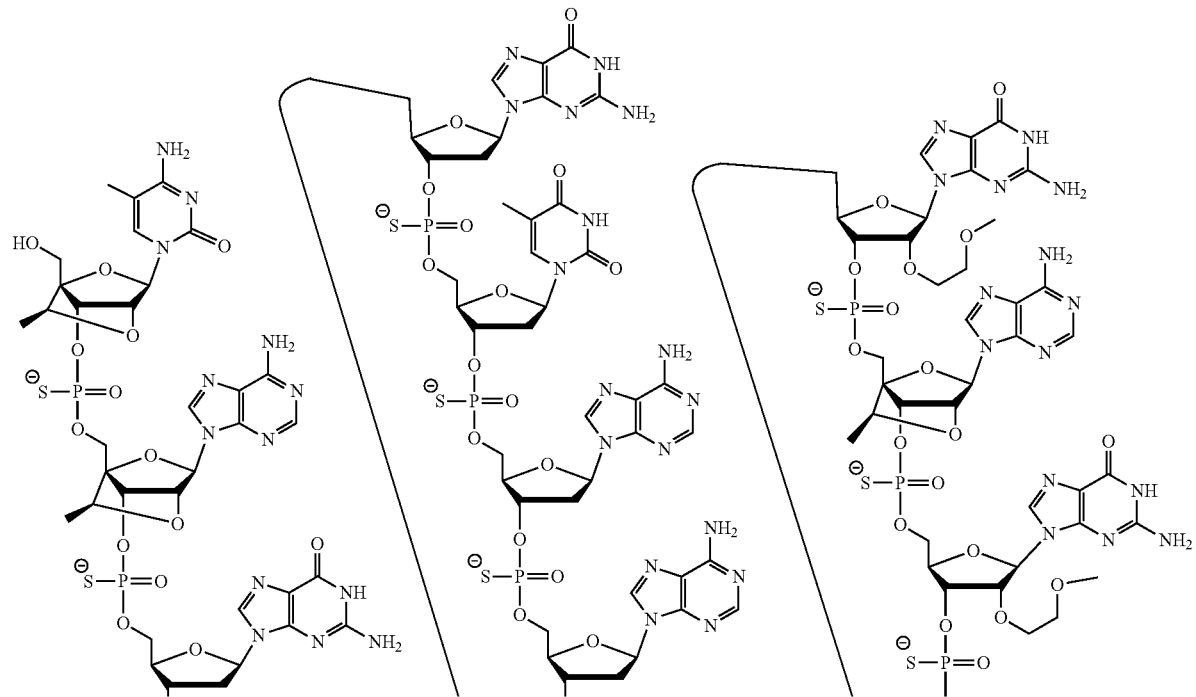
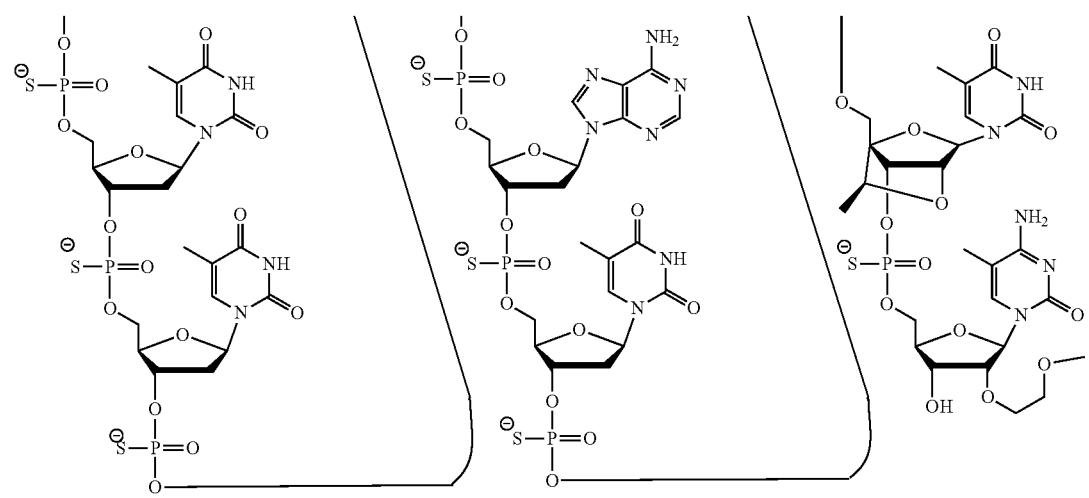

In any of the foregoing methods or uses, the compound can comprise or consist of the sodium salt of ION 935968, having the following chemical structure:

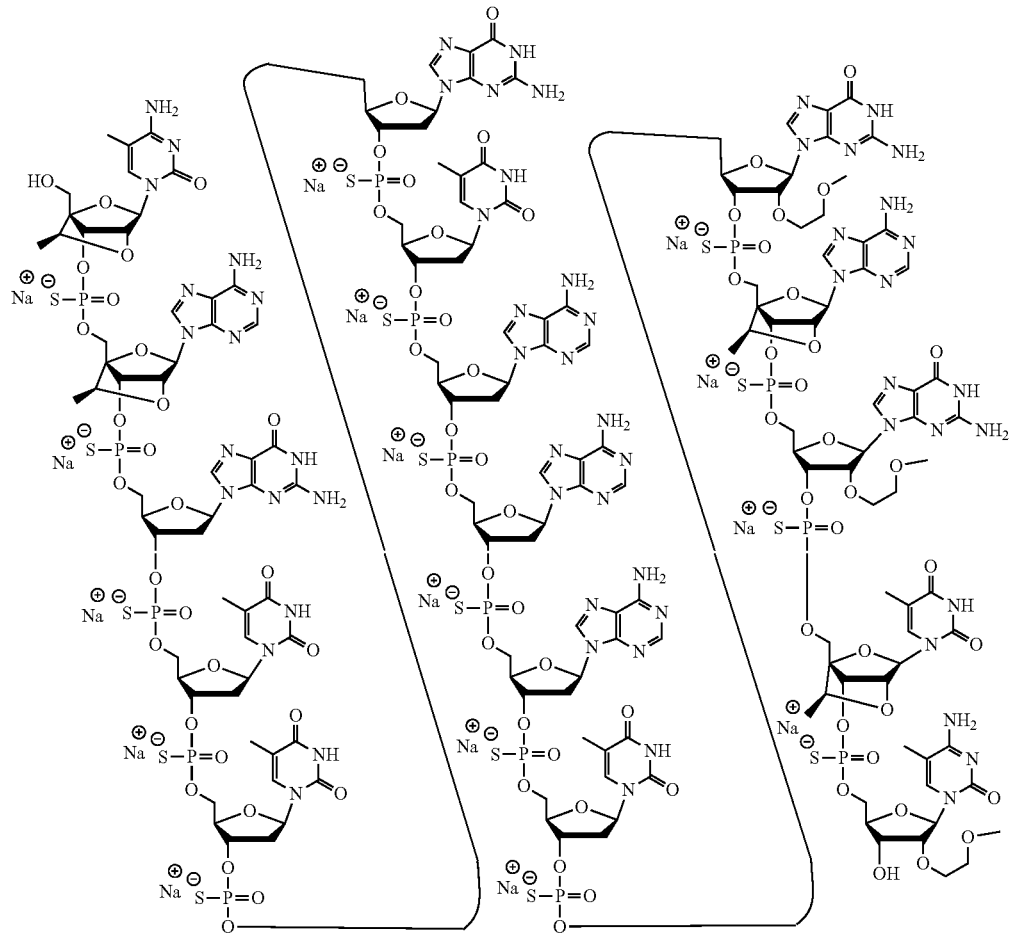

In any of the foregoing methods or uses, the compound can be administered parenterally. For example, in certain embodiments the compound can be administered through injection or infusion. Parenteral administration includes subcutaneous administration, intravenous administration, intramuscular administration, intraarterial administration, intraperitoneal administration, or intracranial administration, e.g. intrathecal or intracerebroventricular administration.

Certain Combinations and Combination Therapies

In certain embodiments, a first agent comprising a compound described herein is co-administered with one or more secondary agents. In certain embodiments, such second agents are designed to treat the same disease, disorder, or condition as the first agent described herein. In certain embodiments, such second agents are designed to treat a different disease, disorder, or condition as the first agent described herein. In certain embodiments, a first agent is designed to treat an undesired side effect of a second agent. In certain embodiments, second agents are co-administered with the first agent to treat an undesired effect of the first agent. In certain embodiments, such second agents are designed to treat an undesired side effect of one or more pharmaceutical compositions as described herein. In certain embodiments, second agents are co-administered with the first agent to produce a combinational effect. In certain embodiments, second agents are co-administered with the first agent to produce a synergistic effect. In certain embodiments, the co-administration of the first and second agents permits use of lower dosages than would be required to achieve a therapeutic or prophylactic effect if the agents were administered as independent therapy.

In certain embodiments, one or more compounds or compositions provided herein are co-administered with one or more secondary agents. In certain embodiments, one or more compounds or compositions provided herein and one or more secondary agents, are administered at different times. In certain embodiments, one or more compounds or compositions provided herein and one or more secondary agents, are prepared together in a single formulation. In certain embodiments, one or more compounds or compositions provided herein and one or more secondary agents, are prepared separately. In certain embodiments, a secondary agent is selected from: proteasome inhibitors including but not limited to bortezomib, carfilzomib, and ixazomib; BTK inhibitors including but not limited to ibrutinib; IMiDs including but not limited to thalidomide, lenalidomide, and pomalidomide; BCL2 inhibitors including but not limited to venetoclax; HDAC inhibitors including but not limited to panobinostat; CDK inhibitors including but not limited to dinaciclib; XPO1 inhibitors including but not limited to selinexor; BET inhibitors including but not limited to CPI-0610; anti-CD38 antibodies including but not limited to daratumumab, isatuximab, and MOR202; anti-CD319 or anti-SLAMF7 antibodies including but not limited to elotuzumab; dexamethasone, cisplatin, doxorubicin, cyclophosphamide, and etoposide.

Certain embodiments are directed to the use of a compound targeted to IRF4 as described herein in combination with a secondary agent. In particular embodiments such use is in a method of treating a patient suffering from cancer including, but not limited to, blood cancer, myeloma, multiple myeloma (MM), B cell malignancies, lymphoma, B cell lymphoma, T cell lymphoma, or leukemia. In certain embodiments, such use is in the preparation or manufacture of a medicament for treating cancer including, but not limited to, blood cancer, myeloma, multiple myeloma (MM), B cell malignancies, lymphoma, B cell lymphoma, T cell lymphoma, or leukemia. In certain embodiments, the B-cell lymphoma is a non-Hodgkin's B-cell lymphoma. Examples of non-Hodgkin's B-cell lymphoma of certain embodiments that can be treated with compounds provided herein include, but are not limited to, diffuse large B cell lymphoma (DLBCL), activated B-cell lymphoma (ABC-DLBCL), germinal center B-cell lymphoma (GCB DLBCL), follicular lymphoma, mucosa-associated lymphatic tissue lymphoma (MALT), small cell lymphocytic lymphoma, chronic lymphocytic leukemia, mantle cell lymphoma (MCL), Burkitt lymphoma, mediastinal large B cell lymphoma, Waldenström macroglobulinemia, nodal marginal zone B cell lymphoma (NMZL), splenic marginal zone lymphoma (SMZL), intravascular large B-cell lymphoma, primary effusion lymphoma, and lymphomatoid granulomatosis. In certain embodiments, the T-cell lymphoma includes, but is not limited to, peripheral T-cell lymphoma, adult T cell leukemia/lymphoma (ATLL), and anaplastic large cell lymphoma (ALCL). In certain embodiments, the leukemia includes, but is not limited to, acute lymphocytic leukemia (ALL). In certain embodiments, a secondary agent is selected from: proteasome inhibitors including but not limited to bortezomib, carfilzomib, and ixazomib; BTK inhibitors including but not limited to ibrutinib; IMiDs including but not limited to thalidomide, lenalidomide, and pomalidomide; BCL2 inhibitors including but not limited to venetoclax; HDAC inhibitors including but not limited to panobinostat; CDK inhibitors including but not limited to dinaciclib; XPO1 inhibitors including but not limited to selinexor; BET inhibitors including but not limited to CPI-0610; anti-CD38 antibodies including but not limited to daratumumab, isatuximab, and MOR202; anti-CD319 or anti-SLAMF7 antibodies including but not limited to elotuzumab; dexamethasone, cisplatin, doxorubicin, cyclophosphamide, and etoposide.

Certain embodiments are drawn to a combination of a compound targeted to IRF4 as described herein and a secondary agent, such as a secondary agent selected from: proteasome inhibitors including but not limited to bortezomib, carfilzomib, and ixazomib; BTK inhibitors including but not limited to ibrutinib; IMiDs including but not limited to thalidomide, lenalidomide, and pomalidomide; BCL2 inhibitors including but not limited to venetoclax; HDAC inhibitors including but not limited to panobinostat; CDK inhibitors including but not limited to dinaciclib; XPO1 inhibitors including but not limited to selinexor; BET inhibitors including but not limited to CPI-0610; dexamethasone, thalidomide, cisplatin, doxorubicin, cyclophosphamide, and etoposide. In certain embodiments, such a combination of a compound targeted to IRF4 as described herein and a secondary agent, such as a secondary agent selected from: proteasome inhibitors including but not limited to bortezomib, carfilzomib, and ixazomib; BTK inhibitors including but not limited to ibrutinib; IMiDs including but not limited to lenalidomide; BCL2 inhibitors including but not limited to venetoclax; HDAC inhibitors including but not limited to panobinostat; CDK inhibitors including but not limited to dinaciclib; XPO1 inhibitors including but not limited to selinexor; BET inhibitors including but not limited to CPI-0610; anti-CD38 antibodies including but not limited to daratumumab, isatuximab, and MOR202; anti-CD319 or anti-SLAMF7 antibodies including but not limited to elotuzumab; dexamethasone, cisplatin, doxorubicin, cyclophosphamide, and etoposide. Such combinations can be useful for reducing or inhibiting cancer cell proliferation, tumor growth, or metastasis and/or treating cancer including, but not limited to, blood cancer, myeloma, multiple myeloma (MM), B cell malignancies, lymphoma, B cell lymphoma, T cell lymphoma, or leukemia.

In certain embodiments the compound targeted to IRF4 as described herein and the secondary agent are used in combination treatment by administering the two agents simultaneously, separately or sequentially. In certain embodiments the two agents are formulated as a fixed dose combination product. In other embodiments the two agents are provided to the patient as separate units which can then either be taken simultaneously or serially (sequentially).

Certain Compounds

In certain embodiments, compounds described herein can be antisense compounds. In certain embodiments, the antisense compound comprises or consists of an oligomeric compound. In certain embodiments, the oligomeric compound comprises a modified oligonucleotide. In certain embodiments, the modified oligonucleotide has a nucleobase sequence complementary to that of a target nucleic acid.

In certain embodiments, a compound described herein comprises or consists of a modified oligonucleotide. In certain embodiments, the modified oligonucleotide has a nucleobase sequence complementary to that of a target nucleic acid.

In certain embodiments, a compound or antisense compound is single-stranded. Such a single-stranded compound or antisense compound comprises or consists of an oligomeric compound. In certain embodiments, such an oligomeric compound comprises or consists of an oligonucleotide and optionally a conjugate group. In certain embodiments, the oligonucleotide is an antisense oligonucleotide. In certain embodiments, the oligonucleotide is modified. In certain embodiments, the oligonucleotide of a single-stranded antisense compound or oligomeric compound comprises a self-complementary nucleobase sequence.

In certain embodiments, compounds are double-stranded. Such double-stranded compounds comprise a first modified oligonucleotide having a region complementary to a target nucleic acid and a second modified oligonucleotide having a region complementary to the first modified oligonucleotide. In certain embodiments, the modified oligonucleotide is an RNA oligonucleotide. In such embodiments, the thymine nucleobase in the modified oligonucleotide is replaced by a uracil nucleobase. In certain embodiments, compound comprises a conjugate group. In certain embodiments, one of the modified oligonucleotides is conjugated. In certain embodiments, both the modified oligonucleotides are conjugated. In certain embodiments, the first modified oligonucleotide is conjugated. In certain embodiments, the second modified oligonucleotide is conjugated. In certain embodiments, the first modified oligonucleotide is 12-30 linked nucleosides in length and the second modified oligonucleotide is 12-30 linked nucleosides in length. In certain embodiments, one of the modified oligonucleotides has a nucleobase sequence comprising at least 8 contiguous nucleobases of any of SEQ ID NOs: 3-3383.

In certain embodiments, antisense compounds are double-stranded. Such double-stranded antisense compounds comprise a first oligomeric compound having a region complementary to a target nucleic acid and a second oligomeric compound having a region complementary to the first oligomeric compound. The first oligomeric compound of such double stranded antisense compounds typically comprises or consists of a modified oligonucleotide and optionally a conjugate group. The oligonucleotide of the second oligomeric compound of such double-stranded antisense compound may be modified or unmodified. Either or both oligomeric compounds of a double-stranded antisense compound may comprise a conjugate group. The oligomeric compounds of double-stranded antisense compounds may include non-complementary overhanging nucleosides.

Examples of single-stranded and double-stranded compounds include but are not limited to oligonucleotides, siRNAs, microRNA targeting oligonucleotides, and single-stranded RNAi compounds, such as small hairpin RNAs (shRNAs), single-stranded siRNAs (ssRNAs), and microRNA mimics.

In certain embodiments, a compound described herein has a nucleobase sequence that, when written in the 5' to 3' direction, comprises the reverse complement of the target segment of a target nucleic acid to which it is targeted.

In certain embodiments, a compound described herein comprises an oligonucleotide 10 to 30 linked subunits in length. In certain embodiments, a compound described herein comprises an oligonucleotide 12 to 30 linked subunits in length. In certain embodiments, a compound described herein comprises an oligonucleotide 12 to 22 linked subunits in length. In certain embodiments, compound described herein comprises an oligonucleotide 14 to 30 linked subunits in length. In certain embodiments, compound described herein comprises an oligonucleotide 14 to 20 linked subunits in length. In certain embodiments, a compound described herein comprises an oligonucleotide 15 to 30 linked subunits in length. In certain embodiments, a compound described herein comprises an oligonucleotide 15 to 20 linked subunits in length. In certain embodiments, a compound described herein comprises an oligonucleotide 16 to 30 linked subunits in length. In certain embodiments, a compound described herein comprises an oligonucleotide 16 to 20 linked subunits in length. In certain embodiments, a compound described herein comprises an oligonucleotide 17 to 30 linked subunits in length. In certain embodiments, a compound described herein comprises an oligonucleotide 17 to 20 linked subunits in length. In certain embodiments, a compound described herein comprises an oligonucleotide 18 to 30 linked subunits in length. In certain embodiments, a compound described herein comprises an oligonucleotide 18 to 21 linked subunits in length. In certain embodiments, a compound described herein comprises an oligonucleotide 18 to 20 linked subunits in length. In certain embodiments, a compound described herein comprises an oligonucleotide 20 to 30 linked subunits in length. In other words, such oligonucleotides are 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, 18 to 21 subunits, 20 to 30 subunits, or 12 to 22 linked subunits in length, respectively. In certain embodiments, a compound described herein comprises an oligonucleotide 14 linked subunits in length. In certain embodiments, a compound described herein comprises an oligonucleotide 16 linked subunits in length. In certain embodiments, a compound described herein comprises an oligonucleotide 17 linked subunits in length. In certain embodiments, compound described herein comprises an oligonucleotide 18 linked subunits in length. In certain embodiments, a compound described herein comprises an oligonucleotide 19 linked subunits in length. In certain embodiments, a compound described herein comprises an oligonucleotide 20 linked subunits in length. In other embodiments, a compound described herein comprises an oligonucleotide 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the compound described herein comprises an oligonucleotide 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In some embodiments the linked subunits are nucleotides, nucleosides, or nucleobases.

In certain embodiments, the compound may further comprise additional features or elements, such as a conjugate group, that are attached to the oligonucleotide. In certain embodiments, such compounds are antisense compounds. In certain embodiments, such compounds are oligomeric compounds. In embodiments where a conjugate group comprises a nucleoside (i.e. a nucleoside that links the conjugate group to the oligonucleotide), the nucleoside of the conjugate group is not counted in the length of the oligonucleotide.

In certain embodiments, compounds may be shortened or truncated. For example, a single subunit may be deleted from the 5' end (5' truncation), or alternatively from the 3' end (3' truncation). A shortened or truncated compound targeted to an IRF4 nucleic acid may have two subunits deleted from the 5' end, or alternatively may have two subunits deleted from the 3' end, of the compound. Alternatively, the deleted nucleosides may be dispersed throughout the compound.

When a single additional subunit is present in a lengthened compound, the additional subunit may be located at the 5' or 3' end of the compound. When two or more additional subunits are present, the added subunits may be adjacent to each other, for example, in a compound having two subunits added to the 5' end (5' addition), or alternatively to the 3' end (3' addition), of the compound. Alternatively, the added subunits may be dispersed throughout the compound.

It is possible to increase or decrease the length of a compound, such as an oligonucleotide, and/or introduce mismatch bases without eliminating activity (Woolf et al. *Proc. Natl. Acad. Sci. USA* 1992, 89:7305-7309; Gautschi et al. *J. Natl. Cancer Inst. March* 2001, 93:463-471; Maher and Dolnick *Nuc. Acid. Res.* 1998, 16:3341-3358). However, seemingly small changes in oligonucleotide sequence, chemistry and motif can make large differences in one or more of the many properties required for clinical development (Seth et al. *J. Med. Chem.* 2009, 52, 10; Egli et al. *J. Am. Chem. Soc.* 2011, 133, 16642).

In certain embodiments, compounds described herein are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term "RNAi" is meant to be equivalent to other terms used to describe sequence specific RNA interference, such as post transcriptional gene silencing, translational inhibition, or epigenetics.

In certain embodiments, a compound described herein can comprise any of the oligonucleotide sequences targeted to IRF4 described herein. In certain embodiments, the compound can be double-stranded. In certain embodiments, the compound comprises a first strand comprising at least an 8, 9, 10, 11, 12, 13, 14, 15, 16, 17, 18, 19, or 20 contiguous nucleobase portion of any one of SEQ ID NOs: 3-3383 and a second strand. In certain embodiments, the compound comprises a first strand comprising the nucleobase sequence of any one of SEQ ID NOs: 3-3383 and a second strand. In certain embodiments, the compound comprises ribonucleotides in which the first strand has uracil (U) in place of thymine (T) in any one of SEQ ID NOs: 3-3383. In certain embodiments, the compound comprises (i) a first strand comprising a nucleobase sequence complementary to the site on IRF4 to which any of SEQ ID NOs: 3-3383 is targeted, and (ii) a second strand. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the dsRNA compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains one or two capped strands, as disclosed, for example, by WO 00/63364, filed Apr. 19, 2000.

In certain embodiments, the first strand of the compound is an siRNA guide strand and the second strand of the compound is an siRNA passenger strand. In certain embodiments, the second strand of the compound is complementary to the first strand. In certain embodiments, each strand of the compound is 16, 17, 18, 19, 20, 21, 22, or 23 linked nucleosides in length. In certain embodiments, the first or second strand of the compound can comprise a conjugate group.

In certain embodiments, a compound described herein can comprise any of the oligonucleotide sequences targeted to IRF4 described herein. In certain embodiments, the compound is single stranded. In certain embodiments, such a compound is a single-stranded RNAi (ssRNAi) compound. In certain embodiments, the compound comprises at least an 8, 9, 10, 11, 12, 13, 14, 15, 16, 17, 18, 19, or 20 contiguous nucleobase portion of any one of SEQ ID NOs: 3-3383. In certain embodiments, the compound comprises the nucleobase sequence of any one of SEQ ID NOs: 3-3383. In certain embodiments, the compound comprises ribonucleotides in which uracil (U) is in place of thymine (T) in any one of SEQ ID NOs: 3-3383. In certain embodiments, the compound comprises a nucleobase sequence complementary to the site on IRF4 to which any of SEQ ID NOs: 3-3383 is targeted. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains a capped strand, as disclosed, for example, by WO 00/63364, filed Apr. 19, 2000. In certain embodiments, the compound consists of 16, 17, 18, 19, 20, 21, 22, or 23 linked nucleosides. In certain embodiments, the compound can comprise a conjugate group.

In certain embodiments, compounds described herein comprise modified oligonucleotides. Certain modified oligonucleotides have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L) such as for amino acids etc. Included in the modified oligonucleotides provided herein are all such possible isomers, including their racemic and optically pure forms, unless specified otherwise. Likewise, all cis- and trans-isomers and tautomeric forms are also included.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^{1}$H hydrogen atoms. Isotopic substitutions encompassed by the compounds herein include but are not limited to: $^{2}$H or $^{3}$H in place of $^{1}$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the compound that are beneficial for use as a therapeutic or research tool. In certain embodiments, radioactive isotopic substitutions may make the compound suitable for research or diagnostic purposes, such as an imaging assay.

Certain Mechanisms

In certain embodiments, compounds described herein comprise or consist of modified oligonucleotides. In certain embodiments, compounds described herein are antisense compounds. In certain embodiments, compounds comprise oligomeric compounds. In certain embodiments, compounds described herein are capable of hybridizing to a target nucleic acid, resulting in at least one antisense activity. In certain embodiments, compounds described herein selectively affect one or more target nucleic acid. Such compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in a significant undesired antisense activity.

In certain antisense activities, hybridization of a compound described herein to a target nucleic acid results in recruitment of a protein that cleaves the target nucleic acid. For example, certain compounds described herein result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, compounds described herein are sufficiently "DNA-like" to elicit RNase H activity. Further, in certain embodiments, one or more non-DNA-like nucleoside in the gap of a gapmer is tolerated.

In certain antisense activities, compounds described herein or a portion of the compound is loaded into an RNA-induced silencing complex (RISC), ultimately resulting in cleavage of the target nucleic acid. For example, certain compounds described herein result in cleavage of the target nucleic acid by Argonaute. Compounds that are loaded into RISC are RNAi compounds. RNAi compounds may be double-stranded (siRNA) or single-stranded (ssRNA).

In certain embodiments, hybridization of compounds described herein to a target nucleic acid does not result in recruitment of a protein that cleaves that target nucleic acid. In certain such embodiments, hybridization of the compound to the target nucleic acid results in alteration of splicing of the target nucleic acid. In certain embodiments, hybridization of the compound to a target nucleic acid results in inhibition of a binding interaction between the target nucleic acid and a protein or other nucleic acid. In certain such embodiments, hybridization of the compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

Target Nucleic Acids, Target Regions and Nucleotide Sequences

In certain embodiments, compounds described herein comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: an mRNA and a pre-mRNA, including intronic, exonic and untranslated regions. In certain embodiments, the target RNA is an mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron.

Nucleotide sequences that encode IRF4 include, without limitation, the following: RefSEQ No. NM_002460.3 and NT_034880.3_TRUNC_328000_354000.

Hybridization

In some embodiments, hybridization occurs between a compound disclosed herein and a IRF4 nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Hybridization conditions are sequence-dependent and are determined by the nature and composition of the nucleic acid molecules to be hybridized.

Methods of determining whether a sequence is specifically hybridizable to a target nucleic acid are well known in the art. In certain embodiments, the compounds provided herein are specifically hybridizable with a IRF4 nucleic acid.

Complementarity

An oligonucleotide is said to be complementary to another nucleic acid when the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine (mC) and guanine (G) unless otherwise specified. Complementary oligonucleotides and/or nucleic acids need not have nucleobase complementarity at each nucleoside and may include one or more nucleobase mismatches. An oligonucleotide is fully complementary or 100% complementary when such oligonucleotides have nucleobase matches at each nucleoside without any nucleobase mismatches.

In certain embodiments, compounds described herein comprise or consist of modified oligonucleotides. In certain embodiments, compounds described herein are antisense compounds. In certain embodiments, compounds comprise oligomeric compounds. Non-complementary nucleobases between a compound and a IRF4 nucleic acid may be tolerated provided that the compound remains able to specifically hybridize to a target nucleic acid. Moreover, a compound may hybridize over one or more segments of a IRF4 nucleic acid such that intervening or adjacent segments are not involved in the hybridization event (e.g., a loop structure, mismatch or hairpin structure).

In certain embodiments, the compounds provided herein, or a specified portion thereof, are, are at least, or are up to 70%, 80%, 85%, 86%, 87%, 88%, 89%, 90%, 91%, 92%, 93%, 94%, 95%, 96%, 97%, 98%, 99%, or 100% complementary to a IRF4 nucleic acid, a target region, target segment, or specified portion thereof. In certain embodiments, the compounds provided herein, or a specified portion thereof, are 70% to 75%, 75% to 80%, 80% to 85%, 85% to 90%, 90% to 95%, 95% to 100%, or any number in between these ranges, complementary to a IRF4 nucleic acid, a target region, target segment, or specified portion thereof. Percent complementarity of a compound with a target nucleic acid can be determined using routine methods.

For example, a compound in which 18 of 20 nucleobases of the compound are complementary to a target region, and would therefore specifically hybridize, would represent 90 percent complementarity. In this example, the remaining non-complementary nucleobases may be clustered or interspersed with complementary nucleobases and need not be contiguous to each other or to complementary nucleobases. As such, a compound which is 18 nucleobases in length having four non-complementary nucleobases which are flanked by two regions of complete complementarity with the target nucleic acid would have 77.8% overall complementarity with the target nucleic acid. Percent complementarity of a compound with a region of a target nucleic acid can be determined routinely using BLAST programs (basic local alignment search tools) and PowerBLAST programs known in the art (Altschul et al., *J. Mol. Biol.,* 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, compounds described herein, or specified portions thereof, are fully complementary (i.e. 100% complementary) to a target nucleic acid, or specified portion thereof. For example, a compound may be fully complementary to a IRF4 nucleic acid, or a target region, or a target segment or target sequence thereof. As used herein, "fully complementary" means each nucleobase of a compound is complementary to the corresponding nucleobase of a target nucleic acid. For example, a 20 nucleobase compound is fully complementary to a target sequence that is 400 nucleobases long, so long as there is a corresponding 20 nucleobase portion of the target nucleic acid that is fully complementary to the compound. Fully complementary can also be used in reference to a specified portion of the first and/or the second nucleic acid. For example, a 20 nucleobase portion of a 30 nucleobase compound can be "fully complementary" to a target sequence that is 400 nucleobases long. The 20 nucleobase portion of the 30 nucleobase compound is fully complementary to the target sequence if the target sequence has a corresponding 20 nucleobase portion wherein each nucleobase is complementary to the 20 nucleobase portion of the compound. At the same time, the entire 30 nucleobase compound may or may not be fully complementary to the target sequence, depending on whether the remaining 10 nucleobases of the compound are also complementary to the target sequence.

In certain embodiments, compounds described herein comprise one or more mismatched nucleobases relative to the target nucleic acid. In certain such embodiments, antisense activity against the target is reduced by such mismatch, but activity against a non-target is reduced by a greater amount. Thus, in certain such embodiments selectivity of the compound is improved. In certain embodiments, the mismatch is specifically positioned within an oligonucleotide having a gapmer motif. In certain such embodiments, the mismatch is at position 1, 2, 3, 4, 5, 6, 7, or 8 from the 5'-end of the gap region. In certain such embodiments, the mismatch is at position 9, 8, 7, 6, 5, 4, 3, 2, 1 from the 3'-end of the gap region. In certain such embodiments, the mismatch is at position 1, 2, 3, or 4 from the 5'-end of the wing region. In certain such embodiments, the mismatch is at position 4, 3, 2, or 1 from the 3'-end of the wing region. In certain embodiments, the mismatch is specifically positioned within an oligonucleotide not having a gapmer motif. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

The location of a non-complementary nucleobase may be at the 5' end or 3' end of the compound. Alternatively, the non-complementary nucleobase or nucleobases may be at an internal position of the compound. When two or more non-complementary nucleobases are present, they may be contiguous (i.e. linked) or non-contiguous. In one embodiment, a non-complementary nucleobase is located in the wing segment of a gapmer oligonucleotide.

In certain embodiments, compounds described herein that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a IRF4 nucleic acid, or specified portion thereof.

In certain embodiments, compounds described herein that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a IRF4 nucleic acid, or specified portion thereof.

In certain embodiments, compounds described herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of a compound. In certain embodiments, thecompounds, are complementary to at least an 8 nucleobase portion of a target segment. In certain embodiments, the compounds are complementary to at least a 9 nucleobase portion of a target segment. In certain embodiments, the compounds are complementary to at least a 10 nucleobase portion of a target segment. In certain embodiments, the compounds are complementary to at least an 11 nucleobase portion of a target segment. In certain embodiments, the compounds are complementary to at least a 12 nucleobase portion of a target segment. In certain embodiments, the compounds are complementary to at least a 13 nucleobase portion of a target segment. In certain embodiments, the compounds are complementary to at least a 14 nucleobase portion of a target segment. In certain embodiments, the compounds are complementary to at least a 15 nucleobase portion of a target segment. In certain embodiments, the compounds are complementary to at least a 16 nucleobase portion of a target segment. Also contemplated are compounds that are complementary to at least a 9, 10, 11, 12, 13, 14, 15, 16, 17, 18, 19, 20, or more nucleobase portion of a target segment, or a range defined by any two of these values.

Identity

The compounds provided herein may also have a defined percent identity to a particular nucleotide sequence, SEQ ID NO, or compound represented by a specific ION number, or portion thereof. In certain embodiments, compounds described herein are antisense compounds or oligomeric compounds. In certain embodiments, compounds described herein are modified oligonucleotides. As used herein, a compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine.

Shortened and lengthened versions of the compounds described herein as well as compounds having non-identical bases relative to the compounds provided herein also are contemplated. The non-identical bases may be adjacent to each other or dispersed throughout the compound. Percent identity of a compound is calculated according to the number of bases that have identical base pairing relative to the sequence to which it is being compared.

In certain embodiments, compounds described herein, or portions thereof, are, or are at least, 70%, 75%, 80%, 85%, 90%, 91%, 92%, 93%, 94%, 95%, 96%, 97%, 98%, 99% or 100% identical to one or more of the compounds or SEQ ID NOs, or a portion thereof, disclosed herein. In certain embodiments, compounds described herein are about 70%, 75%, 80%, 85%, 90%, 91%, 92%, 93%, 94%, 95%, 96%, 97%, 98%, or 99% identical, or any percentage between such values, to a particular nucleotide sequence, SEQ ID NO, or compound represented by a specific ION number, or portion thereof, in which the compounds comprise an oligonucleotide having one or more mismatched nucleobases. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

In certain embodiments, compounds described herein comprise or consist of antisense compounds. In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, compounds described herein comprise or consist of oligonucleotides. In certain embodiments, a portion of the oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Certain Modified Compounds

In certain embodiments, compounds described herein comprise or consist of oligonucleotides consisting of linked nucleosides. Oligonucleotides may be unmodified oligonucleotides (RNA or DNA) or may be modified oligonucleotides. Modified oligonucleotides comprise at least one modification relative to unmodified RNA or DNA (i.e., comprise at least one modified nucleoside (comprising a modified sugar moiety and/or a modified nucleobase) and/or at least one modified internucleoside linkage).

A. Modified Nucleosides

Modified nucleosides comprise a modified sugar moiety or a modified nucleobase or both a modified sugar moiety and a modified nucleobase.

1. Modified Sugar Moieties

In certain embodiments, sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more acyclic substituent, including but not limited to substituents at the 2', 4', and/or 5' positions. In certain embodiments one or more acyclic substituent of non-bicyclic modified sugar moieties is branched. Examples of 2'-substituent groups suitable for non-bicyclic modified sugar moieties include but are not limited to: 2'-F, 2'-OCH$_3$-("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for linearly non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugars comprise more than one non-bridging sugar substituent, for example, 2'-F-5'-methyl sugar moieties and the modified sugar moieties and modified nucleosides described in Migawa et al., US2010/190837 and Rajeev et al., US2013/0203836.

In certain embodiments, a 2'-substituted nucleoside or 2'-non-bicyclic modified nucleoside comprises a sugar moiety comprising a linear 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside or 2'-non-bicyclic modified nucleoside comprises a sugar moiety comprising a linear 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted nucleoside or 2'-non-bicyclic modified nucleoside comprises a sugar moiety comprising a linear 2'-substituent group selected from: F, OCH$_3$, and OCH$_2$CH$_2$OCH$_3$.

Nucleosides comprising modified sugar moieties, such as non-bicyclic modified sugar moieties, are referred to by the position(s) of the substitution(s) on the sugar moiety of the nucleoside. For example, nucleosides comprising 2'-substituted or 2-modified sugar moieties are referred to as 2'-substituted nucleosides or 2-modified nucleosides.

Certain modified sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_3$)—O-2' (referred to as "constrained ethyl" or "cEt" when in the S configuration), 4'-CH₂—O—CH₂-2', 4'-CH₂—N(R)-2', 4'-CH(CH₂OCH₃)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH₃)(CH₃)—O-2' and analogs thereof (see, e.g., Seth et al., U.S. Pat. No. 8,278,283), 4'-CH₂—N (OCH₃)-2' and analogs thereof (see, e.g., Prakash et al., U.S. Pat. No. 8,278,425), 4'-CH₂—O—N(CH₃)-2' (see, e.g., Allerson et al., U.S. Pat. No. 7,696,345 and Allerson et al., U.S. Pat. No. 8,124,745), 4'-CH₂—C(H)(CH₃)-2' (see, e.g., Zhou, et al., *J. Org. Chem.*, 2009, 74, 118-134), 4'-CH₂—C(=CH₂)-2' and analogs thereof (see e.g., Seth et al., U.S. Pat. No. 8,278,426), 4'-C(R$_a$R$_b$)—N(R)—O-2', 4'-C (R$_a$R$_b$)—O—N(R)-2', 4'-CH₂—O—N(R)-2', and 4'-CH₂—N(R)—O-2', wherein each R, R$_a$, and R$_b$ is, independently, H, a protecting group, or $C_1$-$C_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, 4C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)₂—, —S(=O)$_x$—, and —N(R$_a$)—;
wherein:
x is 0, 1, or 2;
n is 1, 2, 3, or 4;
each R$_a$ and R$_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)₂-J$_1$), or sulfoxyl (S(=O)-J$_1$); and each J$_1$ and J$_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A.*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129, 8362-8379; Elayadi et al., *Curr. Opinion Invens. Drugs*, 2001, 2, 558-561; Braasch et al., *Chem. Biol.*, 2001, 8, 1-7; Orum et al., *Curr. Opinion Mol. Ther.*, 2001, 3, 239-243; Wengel et al., U.S. Pat. No. 7,053,207, Imanishi et al., U.S. Pat. No. 6,268,490, Imanishi et al. U.S. Pat. No. 6,770,748, Imanishi et al., U.S. RE44,779; Wengel et al., U.S. Pat. No. 6,794,499, Wengel et al., U.S. Pat. No. 6,670,461; Wengel et al., U.S. Pat. No. 7,034,133, Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; Allerson et al., US2008/0039618; and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

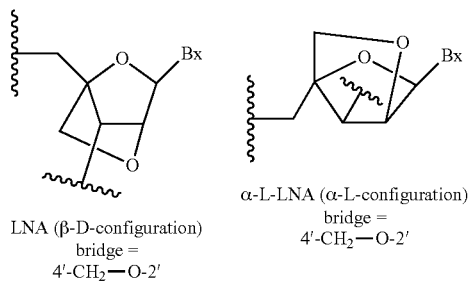

LNA (β-D-configuration)
bridge =
4'-CH₂—O-2'

α-L-LNA (α-L-configuration)
bridge =
4'-CH₂—O-2'

α-L-methyleneoxy (4'-CH₂—O-2') or α-L-LNA bicyclic nucleosides have been incorporated into oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see e.g., Leumann, C J. *Bioorg. & Med. Chem.* 2002, 10, 841-854), fluoro HNA:

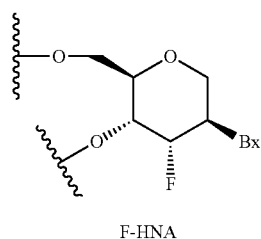

F-HNA ("F-HNA", see e.g., Swayze et al., U.S. Pat. No. 8,088,904; Swayze et al., U.S. Pat. No. 8,440,803; and Swayze et al., U.S. Pat. No. 9,005,906, F-HNA can also be referred to as a F-THP or 3'-fluoro tetrahydropyran), and nucleosides comprising additional modified THP compounds having the formula:

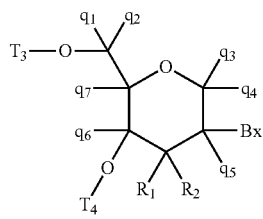

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group; $q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

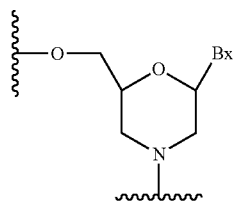

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., US2013/130378.

Many other bicyclic and tricyclic sugar and sugar surrogate ring systems are known in the art that can be used in modified nucleosides.

2. Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds.

In certain embodiments, compounds described herein comprise modified oligonucleotides. In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and 0-6 substituted purines. In certain embodiments, modified nucleobases are selected from: 2-aminopropyladenine, 5-hydroxymethyl cytosine, 5-methylcytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (C≡C—CH$_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in The Concise Encyclopedia Of Polymer Science And Engineering, Kroschwitz, J. I., Ed., John Wiley & Sons, 1990, 858-859; Englisch et al., Angewandte Chemie, International Edition, 1991, 30, 613; Sanghvi, Y. S., Chapter 15, Antisense Research and Applications, Crooke, S. T. and Lebleu, B., Eds., CRC Press, 1993, 273-288; and those disclosed in Chapters 6 and 15, Antisense Drug Technology, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403, Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., U.S. Pat. No. 6,166,199; and Matteucci et al., U.S. Pat. No. 6,005,096.

In certain embodiments, compounds targeted to a IRF4 nucleic acid comprise one or more modified nucleobases. In certain embodiments, the modified nucleobase is 5-methylcytosine. In certain embodiments, each cytosine is a 5-methylcytosine.

3. Modified Internucleoside Linkages

The naturally occurring internucleoside linkage of RNA and DNA is a 3' to 5' phosphodiester linkage In certain embodiments, compounds described herein having one or more modified, i.e. non-naturally occurring, internucleoside linkages are often selected over compounds having naturally occurring internucleoside linkages because of desirable properties such as, for example, enhanced cellular uptake, enhanced affinity for target nucleic acids, and increased stability in the presence of nucleases.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

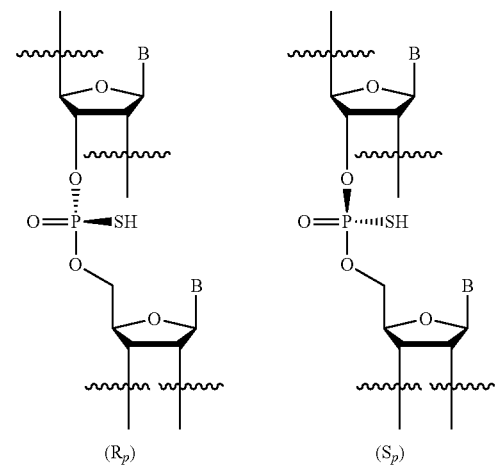

Unless otherwise indicated, chiral internucleoside linkages of modified oligonucleotides described herein can be stereorandom or in a particular stereochemical configuration.

In certain embodiments, compounds targeted to an IRF4 nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

In certain embodiments, compounds described herein comprise oligonucleotides. Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS—P=S"). Representative non-phosphorus containing internucleoside linking groups include but are not limited to methylenemethylimino (—CH2-N(CH3)-O—CH2-), thiodiester, thionocarbamate (—O—C(=O)(NH)—S—); siloxane (—O—SiH2-O—); and N,N'-dimethylhydrazine (—CH2-N(CH3)-N(CH3)-). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Representative chiral internucleoside linkages include but are not limited to alkylphosphonates and phosphorothioates. Methods of preparation of phosphorous-containing and non-phosphorous-containing internucleoside linkages are well known to those skilled in the art.

Neutral internucleoside linkages include, without limitation, phosphotriesters, methylphosphonates, MMI (3'-CH2-N(CH3)-O-5'), amide-3 (3'-CH2-C(=O)—N(H)-5'), amide-4 (3'-CH2-N(H)—C(=O)-5'), formacetal (3'-O—CH2-O-5), methoxypropyl, and thioformacetal (3'-S—CH2-O-5'). Further neutral internucleoside linkages include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook, Eds., ACS Symposium Series 580; Chapters 3 and 4, 40-65). Further neutral internucleoside linkages include nonionic linkages comprising mixed N, O, S and CH2 component parts.

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif. In such embodiments, the internucleoside linkages in each of two wing regions are different from the internucleoside linkages in the gap region. In certain embodiments the internucleoside linkages in the wings are phosphodiester and the internucleoside linkages in the gap are phosphorothioate. The nucleoside motif is independently selected, so such oligonucleotides having a gapped internucleoside linkage motif may or may not have a gapped nucleoside motif and if it does have a gapped nucleoside motif, the wing and gap lengths may or may not be the same.

In certain embodiments, oligonucleotides comprise a region having an alternating internucleoside linkage motif. In certain embodiments, oligonucleotides comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosphonate linkages. In certain embodiments, oligonucleotides having a gapmer nucleoside motif comprise a linkage motif comprising all phosphorothioate linkages except for one or two methylphosponate linkages. In certain embodiments, one methylphosponate linkage is in the central gap of an oligonucleotide having a gapmer nucleoside motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments it is desirable to decrease the number of phosphorothioate internucleoside linkages while retaining nuclease resistance. In certain embodiments it is desirable to increase the number of phosphodiester internucleoside linkages while retaining nuclease resistance.

Certain Motifs

In certain embodiments, compounds described herein comprise oligonucleotides. Oligonucleotides can have a motif, e.g. a pattern of unmodified and/or modified sugar moieties, nucleobases, and/or internucleoside linkages. In certain embodiments, modified oligonucleotides comprise one or more modified nucleoside comprising a modified sugar. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

a. Certain Sugar Motifs

In certain embodiments, compounds described herein comprise oligonucleotides. In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which comprises two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, the wings of a gapmer comprise 2-5 nucleosides. In certain embodiments, the wings of a gapmer comprise 3-5 nucleosides. In certain embodiments, the nucleosides of a gapmer are all modified nucleosides.

In certain embodiments, the gap of a gapmer comprises 7-12 nucleosides. In certain embodiments, the gap of a gapmer comprises 7-10 nucleosides. In certain embodiments, the gap of a gapmer comprises 8-10 nucleosides. In certain embodiments, the gap of a gapmer comprises 10 nucleosides. In certain embodiment, each nucleoside of the gap of a gapmer is an unmodified 2'-deoxy nucleoside.

In certain embodiments, the gapmer is a deoxy gapmer. In such embodiments, the nucleosides on the gap side of each wing/gap junction are unmodified 2'-deoxy nucleosides and the nucleosides on the wing sides of each wing/gap junction are modified nucleosides. In certain such embodiments, each nucleoside of the gap is an unmodified 2'-deoxy nucleoside. In certain such embodiments, each nucleoside of each wing is a modified nucleoside.

In certain embodiments, a modified oligonucleotide has a fully modified sugar motif wherein each nucleoside of the modified oligonucleotide comprises a modified sugar moiety. In certain embodiments, modified oligonucleotides comprise or consist of a region having a fully modified sugar motif wherein each nucleoside of the region comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

In certain embodiments, a modified oligonucleotide can comprise a sugar motif described in Swayze et al., US2010/0197762; Freier et al., US2014/0107330; Freier et al., US2015/0184153; and Seth et al., US2015/0267195, each of which is incorporated by reference in its entirety herein.

Certain embodiments provided herein are directed to modified oligomeric compounds useful for inhibiting target nucleic acid expression, which can be useful for treating, preventing, ameliorating, or slowing progression of a disease associated with such a target nucleic acid. In certain embodiments, the modified oligomeric compounds comprise antisense oligonucleotides that are gapmers having certain sugar motifs. In certain embodiments, the gapmer sugar motifs provided herein can be combined with any nucleobase sequence and any internucleoside linkage motif to form potent antisense oligonucleotides.

In certain embodiments, a method comprises contacting a cell or administering to a subject a compound comprising a modified oligonucleotide 16 linked nucleosides in length having the motif: ekk-d9-kkee, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide 16 linked nucleosides in length having the motif: k-d9-kekeke, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide 16 linked nucleosides in length having the motif: kkk-d8-kekek, wherein 'd' represents a 2'-deoxyribose sugar, 1' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide 16 linked nucleosides in length having the motif: kkk-d9-keke, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide 16 linked nucleosides in length having the motif: kk-d9-kdkdk, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a compound comprises a modified oligonucleotide 16 linked nucleosides in length having the motif: kk-d9-eeekk, wherein 'd' represents a 2'-deoxyribose sugar, 'k' represents a cEt nucleoside, and 'e' represents a 2'-MOE nucleoside. In certain embodiments, a method comprises contacting a cell or administering to a subject a compound comprising a modified oligonucleotide 16 linked nucleosides in length having the motif: kk-d9-eeekk, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide 16 linked nucleosides in length having the motif: kk-d9-ekeke, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

b. Certain Nucleobase Motifs

In certain embodiments, compounds described herein comprise oligonucleotides. In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

c. Certain Internucleoside Linkage Motifs

In certain embodiments, compounds described herein comprise oligonucleotides. In certain embodiments, oligonucleotides comprise modified and/or unmodified internucleoside linkages arranged along the oligonucleotide or region thereof in a defined pattern or motif. In certain embodiments, essentially each internucleoside linking group is a phosphate internucleoside linkage (P=O). In certain embodiments, each internucleoside linking group of a modified oligonucleotide is a phosphorothioate (P=S). In certain embodiments, each internucleoside linking group of a modified oligonucleotide is independently selected from a phosphorothioate and phosphate internucleoside linkage. In certain embodiments, the sugar motif of a modified oligonucleotide is a gapmer and the internucleoside linkages within the gap are all modified. In certain such embodiments, some or all of the internucleoside linkages in the wings are unmodified phosphate linkages. In certain embodiments, the terminal internucleoside linkages are modified.

4. Certain Modified Oligonucleotides

In certain embodiments, compounds described herein comprise modified oligonucleotides. In certain embodiments, the above modifications (sugar, nucleobase, internucleoside linkage) are incorporated into a modified oligonucleotide. In certain embodiments, modified oligonucleotides are characterized by their modification, motifs, and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such gapmer oligonucleotides may comprise one or more modified nucleobase independent of the gapmer pattern of the sugar modifications. Furthermore, in certain instances, an oligonucleotide is described by an overall length or range and by lengths or length ranges of two or more regions (e.g., a regions of nucleosides having specified sugar modifications), in such circumstances it may be possible to select numbers for each range that result in an oligonucleotide having an overall length falling outside the specified range. In such circumstances, both elements must be satisfied. For example, in certain embodiments, a modified oligonucleotide consists of 15-20 linked nucleosides and has a sugar motif consisting of three regions, A, B, and C, wherein region A consists of 2-6 linked nucleosides having a specified sugar motif, region B consists of 6-10 linked nucleosides having a specified sugar motif, and region C consists of 2-6 linked nucleosides having a specified sugar motif. Such embodiments do not include modified oligonucleotides where A and C each consist of 6 linked nucleosides and B consists of 10 linked nucleosides (even though those numbers of nucleosides are permitted within the requirements for A, B, and C) because the overall length of such oligonucleotide is 22, which exceeds the upper limit of the overall length of the modified oligonucleotide (20). Herein, if a description of an oligonucleotide is silent with respect to one or more parameter, such parameter is not limited. Thus, a modified oligonucleotide described only as having a gapmer sugar motif without further description may have any length, internucleoside linkage motif, and nucleobase motif. Unless otherwise indicated, all modifications are independent of nucleobase sequence.

Certain Conjugated Compounds

In certain embodiments, the compounds described herein comprise or consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

In certain embodiments, the oligonucleotide is modified. In certain embodiments, the oligonucleotide of a compound has a nucleobase sequence that is complementary to a target nucleic acid. In certain embodiments, oligonucleotides are complementary to a messenger RNA (mRNA). In certain embodiments, oligonucleotides are complementary to a sense transcript.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance In certain embodiments, conjugate groups impart a new property on the attached oligonucleotide, e.g., fluorophores or reporter groups that enable detection of the oligonucleotide.

Certain conjugate groups and conjugate moieties have been described previously, for example: cholesterol moiety (Letsinger et al., *Proc. Natl. Acad. Sci. USA*, 1989, 86, 6553-6556), cholic acid (Manoharan et al., *Bioorg. Med. Chem. Lett.*, 1994, 4, 1053-1060), a thioether, e.g., hexyl-S-tritylthiol (Manoharan et al., *Ann. N.Y. Acad. Sci.*, 1992, 660, 306-309; Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e.g., do-decan-diol or undecyl residues (Saison-Behmoaras et al., *EMBO* 1, 1991, 10, 1111-1118; Kabanov et al., *FEBS Lett.*, 1990, 259, 327-330; Svinarchuk et al., *Biochimie*, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic, a palmityl moiety (Mishra et al., *Biochim. Biophys. Acta*, 1995, 1264, 229-237), an octadecylamine or hexylamino-carbonyl-oxycholesterol moiety (Crooke et al., *J. Pharmacol. Exp. Ther.*, 1996, i, 923-937), a tocopherol group (Nishina et al., *Molecular Therapy Nucleic Acids*, 2015, 4, e220; doi:10.1038/mtna.2014.72 and Nishina et al., *Molecular Therapy*, 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates (e.g., GalNAc), vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain compounds, a conjugate group is a single chemical bond (i.e. conjugate moiety is attached to an oligonucleotide via a conjugate linker through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N- benzoylcytosine, 5-methylcytosine, 4-N-benzoyl-5-methylcytosine, adenine, 6-N-benzoyladenine, guanine and 2-N-isobutyrylguanine. It is typically desirable for linker-nucleosides to be cleaved from the compound after it reaches a target tissue. Accordingly, linker-nucleosides are typically linked to one another and to the remainder of the compound through cleavable bonds. In certain embodiments, such cleavable bonds are phosphodiester bonds.

Herein, linker-nucleosides are not considered to be part of the oligonucleotide. Accordingly, in embodiments in which a compound comprises an oligonucleotide consisting of a specified number or range of linked nucleosides and/or a specified percent complementarity to a reference nucleic acid and the compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, a compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such a compound is more than 30. Alternatively, an compound may comprise a modified oligonucleotide consisting of 8-30 nucleosides and no conjugate group. The total number of contiguous linked nucleosides in such a compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances compounds comprising a particular conjugate moiety are better taken up by a particular cell type, but once the compound has been taken up, it is desirable that the conjugate group be cleaved to release the unconjugated or parent oligonucleotide. Thus, certain conjugate may comprise one or more cleavable moieties, typically within the conjugate linker. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, one or more linker-nucleosides are linked to one another and/or to the remainder of the compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

Compositions and Methods for Formulating Pharmaceutical Compositions

Compounds described herein may be admixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

Certain embodiments provide pharmaceutical compositions comprising one or more compounds or a salt thereof. In certain embodiments, the compounds are antisense compounds or oligomeric compounds. In certain embodiments, the compounds comprise or consist of a modified oligonucleotide. In certain such embodiments, the pharmaceutical composition comprises a suitable pharmaceutically acceptable diluent or carrier. In certain embodiments, a pharmaceutical composition comprises a sterile saline solution and one or more compound. In certain embodiments, such pharmaceutical composition consists of a sterile saline solution and one or more compound. In certain embodiments, the sterile saline is pharmaceutical grade saline. In certain embodiments, a pharmaceutical composition comprises one or more compound and sterile water. In certain embodiments, a pharmaceutical composition consists of one compound and sterile water. In certain embodiments, the sterile water is pharmaceutical grade water. In certain embodiments, a pharmaceutical composition comprises one or more compound and phosphate-buffered saline (PBS). In certain embodiments, a pharmaceutical composition consists of one or more compound and sterile PBS. In certain embodiments, the sterile PBS is pharmaceutical grade PBS. Compositions and methods for the formulation of pharmaceutical compositions are dependent upon a number of criteria, including, but not limited to, route of administration, extent of disease, or dose to be administered.

A compound described herein targeted to IRF4 nucleic acid can be utilized in pharmaceutical compositions by combining the compound with a suitable pharmaceutically acceptable diluent or carrier. In certain embodiments, a pharmaceutically acceptable diluent is water, such as sterile water suitable for injection. Accordingly, in one embodiment, employed in the methods described herein is a pharmaceutical composition comprising a compound targeted to IRF4 nucleic acid and a pharmaceutically acceptable diluent. In certain embodiments, the pharmaceutically acceptable diluent is water. In certain embodiments, the compound comprises or consists of a modified oligonucleotide provided herein.

Pharmaceutical compositions comprising compounds provided herein encompass any pharmaceutically acceptable salts, esters, or salts of such esters, or any other oligonucleotide which, upon administration to an animal, including a human, is capable of providing (directly or indirectly) the biologically active metabolite or residue thereof. In certain embodiments, the compounds are antisense compounds or oligomeric compounds. In certain embodiments, the compound comprises or consists of a modified oligonucleotide.

Accordingly, for example, the disclosure is also drawn to pharmaceutically acceptable salts of compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of a compound which are cleaved by endogenous nucleases within the body, to form the active compound. In certain embodiments, the compounds or compositions further comprise a pharmaceutically acceptable carrier or diluent.

EXAMPLES

The Examples below describe the screening process to identify lead compounds targeted to IRF4. Out of over 3,000 oligonucleotides that were screened, ION 690890, 935658, 935696, 935762, 935918, 935968, 882800, 1012795, 1014095, and 1014834 emerged as the top lead compounds. In particular, ION 935918 exhibited the best combination of properties in terms of potency and tolerability out of over 3,000 oligonucleotides.

Non-Limiting Disclosure and Incorporation by Reference

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH for the natural 2'-H of DNA) or as an RNA having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligonucleotide having the nucleobase sequence "ATCGATCG" encompasses any oligonucleotides having such nucleobase sequence, whether modified or unmodified, including, but not limited to, such compounds comprising RNA bases, such as those having sequence "AUCGAUCG" and those having some DNA bases and some RNA bases such as "AUCGATCG" and compounds having other modified nucleobases, such as "AT$^m$CGAUCG," wherein $^m$C indicates a cytosine base comprising a methyl group at the 5-position.

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Effect of 5-10-5 MOE Gapmers with Phosphorothioate Internucleoside Linkages on Human IRF4 In Vitro, Single Dose Modified oligonucleotides complementary to a human IRF4 nucleic acid were designed and tested for their effect on IRF4 mRNA in vitro.

Cultured SK-MEL-28 cells at a density of 60,000 cells per well were transfected using electroporation with 20,000 nM concentration of modified oligonucleotide or no modified oligonucleotide for untreated controls. After approximately 24 hours, RNA was isolated from the cells and IRF4 mRNA levels were measured by quantitative real-time PCR. Human primer probe set RTS3114 (forward sequence AAGCCTTGGCGTTCTCAGACT, designated herein as SEQ ID NO: 3386; reverse sequence TCAGCTCCTT-CACGAGGATTTC, designated herein as SEQ ID NO: 3387; probe sequence CCGGCTGCACATCTGCCTGTAC-TACC, designated herein as SEQ ID: 3388) was used to measure mRNA levels. IRF4 mRNA levels were adjusted according to total RNA content, as measured by RIBOGREEN®. Results are presented in the table below as percent control of the amount of IRF4 mRNA, relative to untreated control (UTC) cells.

The modified oligonucleotides in Table 1 are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides. The sugar motif for the gapmers is (from 5' to 3'): eeeeedddddddddd-deeeee; wherein 'd' represents a 2'-deoxyribose sugar and 'e' represents a 2'-MOE modified sugar. Each internucleoside linkage is a phosphorothioate internucleoside linkage and each cytosine residue is a 5-methylcytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Table 1 below is complementary to human IRF4 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to human IRF4 reduced the amount of human IRF4 mRNA.

TABLE 1

Percent control of human IRF4 mRNA with 5-10-5 MOE gapmers with phosphorothioate internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence | IRF4 (% UTC) | SEQ ID NO |
|---|---|---|---|---|---|---|---|
| 434887 | 164 | 183 | 5191 | 5210 | GCAGCTCACCGCGCTCATGC | 57 | 3 |
| 434888 | 175 | 194 | 5202 | 5221 | TTCCCGTTGCCGCAGCTCAC | 34 | 4 |
| 434889 | 190 | 209 | 5217 | 5236 | AGCCACTGGCGGAGCTTCCC | 43 | 5 |

TABLE 1-continued

Percent control of human IRF4 mRNA with 5-10-5 MOE gapmers with phosphorothioate internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence | IRF4 (% UTC) | SEQ ID NO |
|---|---|---|---|---|---|---|---|
| 434890 | 294 | 313 | 5321 | 5340 | TGTAGTCCTGCTTGCCCGCG | 51 | 6 |
| 434891 | 304 | 323 | 5331 | 5350 | TCCTCGCGGTTGTAGTCCTG | 53 | 7 |
| 434892 | 330 | 349 | N/A | N/A | CCCAAGCCTTGAAGAGCGCG | 44 | 8 |
| 434893 | 367 | 386 | 6846 | 6865 | TTGTCGATGCCTTCTCGGAA | 47 | 9 |
| 434894 | 375 | 394 | 6854 | 6873 | GGTCCGGCTTGTCGATGCCT | 40 | 10 |
| 434895 | 430 | 449 | 6909 | 6928 | TCAAAGTCATTGCTCTTGTT | 55 | 11 |
| 434896 | 436 | 455 | 6915 | 6934 | AGTTCCTCAAAGTCATTGCT | 42 | 12 |
| 434897 | 442 | 461 | 6921 | 6940 | TCAACCAGTTCCTCAAAGTC | 75 | 13 |
| 434898 | 447 | 466 | 6926 | 6945 | TCCGCTCAACCAGTTCCTCA | 32 | 14 |
| 434899 | 474 | 493 | 6953 | 6972 | TGTACGGGTCTGAGATGTCC | 44 | 15 |
| 434900 | 532 | 551 | 7850 | 7869 | TCCAGGGTGAGCTGCTTGGC | 43 | 16 |
| 434901 | 555 | 574 | 7873 | 7892 | GGCTCATGGACATCTGCGGG | 45 | 17 |
| 434902 | 675 | 694 | 9165 | 9184 | TTTCCGGGTGTGGCTGATCC | 36 | 18 |
| 434903 | 690 | 709 | 9180 | 9199 | GACATTGGTACGGGATTTCC | 38 | 19 |
| 434904 | 732 | 751 | 9222 | 9241 | CTGGGCCTTGCCAGTGGTGG | 59 | 20 |
| 434905 | 739 | 758 | 9229 | 9248 | TCACAAGCTGGGCCTTGCCA | 30 | 21 |
| 434906 | 744 | 763 | 9234 | 9253 | CATTTTCACAAGCTGGGCCT | 37 | 22 |
| 434907 | 751 | 770 | N/A | N/A | TGGCAACCATTTTCACAAGC | 37 | 23 |
| 434908 | 758 | 777 | N/A | N/A | TGTCACCTGGCAACCATTTT | 49 | 24 |
| 434909 | 778 | 797 | 10843 | 10862 | GCACAAGCATAAAAGGTTCC | 26 | 25 |
| 434916 | 940 | 959 | 13493 | 13512 | TGGGAGATCCGGCAGCCCTC | 66 | 26 |
| 434917 | 1004 | 1023 | 13557 | 13576 | GCCATTGTCCTCTGGGTAGG | 38 | 27 |
| 434918 | 1042 | 1061 | 13595 | 13614 | TCCAGGTGGCTCAGCAGCTT | 25 | 28 |
| 434919 | 1063 | 1082 | 13616 | 13635 | ATCCAGAGGACCACGCCCCT | 78 | 29 |
| 434920 | 1068 | 1087 | 13621 | 13640 | GGGCCATCCAGAGGACCACG | 36 | 30 |
| 434921 | 1119 | 1138 | 13672 | 13691 | CGTCCCAGTAGATCCTGCTC | 46 | 31 |
| 434922 | 1187 | 1206 | 13740 | 13759 | GTCAAAGAGCTTGCAGGTCT | 32 | 32 |
| 434923 | 1192 | 1211 | 13745 | 13764 | TGTGTGTCAAAGAGCTTGCA | 17 | 33 |
| 434924 | 1344 | 1363 | 19461 | 19480 | GTTGTCTGGCTAGCAGAGGT | 33 | 34 |
| 434925 | 1364 | 1383 | 19481 | 19500 | TTGTTGAGCAAAATAATATA | 97 | 35 |
| 434926 | 1391 | 1410 | 19508 | 19527 | GTAGCCCCTCAGGAAATGTC | 15 | 36 |
| 434927 | 1420 | 1439 | 19537 | 19556 | TCTGGATTGCTGATGTGTTC | 46 | 37 |
| 434928 | 1430 | 1449 | 19547 | 19566 | GTGGTAATCTTCTGGATTGC | 42 | 38 |
| 434929 | 1450 | 1469 | 19567 | 19586 | GAGGAATGGCGGATAGATCT | 63 | 39 |
| 434930 | 1707 | 1726 | 19824 | 19843 | CACTAAAGTCAAATATTTAC | 88 | 40 |
| 434931 | 1712 | 1731 | 19829 | 19848 | GCTTTCACTAAAGTCAAATA | 29 | 41 |
| 434932 | 1821 | 1840 | 19938 | 19957 | CAGATGTCACTGATTTTCCA | 41 | 42 |

TABLE 1-continued

Percent control of human IRF4 mRNA with 5-10-5 MOE gapmers with phosphorothioate internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence | IRF4 (% UTC) | SEQ ID NO |
|---|---|---|---|---|---|---|---|
| 434933 | 1826 | 1845 | 19943 | 19962 | CCAATCAGATGTCACTGATT | 44 | 43 |
| 434934 | 1838 | 1857 | 19955 | 19974 | TAAGCTCATCTGCCAATCAG | 71 | 44 |
| 434935 | 2196 | 2215 | 20313 | 20332 | CCAAGGCTACAGGCACGGCT | 29 | 45 |
| 434936 | 2234 | 2253 | 20351 | 20370 | ACACCAGGAAACCGCTGGCA | 37 | 46 |
| 434937 | 2293 | 2312 | 20410 | 20429 | CTTCCAGGAAAGGCCAAGGA | 23 | 47 |
| 434938 | 2356 | 2375 | 20473 | 20492 | TGTCCCATCCAAGAGTAGCG | 30 | 48 |
| 434939 | 2662 | 2681 | 20779 | 20798 | CTTCCAGTGGTGGGTCCTGG | 53 | 49 |
| 434940 | 2705 | 2724 | 20822 | 20841 | AACAGCCCACTGAGTGTGCA | 43 | 50 |
| 434941 | 2711 | 2730 | 20828 | 20847 | AGCAGAAACAGCCCACTGAG | 58 | 51 |
| 434942 | 3435 | 3454 | 21552 | 21571 | CTGGGTACATGGCAGTGGAG | 27 | 52 |
| 434943 | 3805 | 3824 | 21922 | 21941 | GCATTTTCCAGAAAATTCAG | 33 | 53 |
| 434944 | 4477 | 4496 | 22594 | 22613 | CCCAGAGTTGTTCCACCCCT | 21 | 54 |
| 434945 | N/A | N/A | 22826 | 22845 | GCTGGCCACAGAGGACTTCG | 21 | 55 |
| 434946 | 4737 | 4756 | 22854 | 22873 | GCCTTCACGCACCATTCAGA | 52 | 56 |
| 434947 | 4812 | 4831 | 22929 | 22948 | CCACCTGCATCGAGATCAGT | 31 | 57 |
| 434948 | 4818 | 4837 | 22935 | 22954 | GGAGATCCACCTGCATCGAG | 32 | 58 |
| 434949 | 5035 | 5054 | 23152 | 23171 | GGAAGTGGACCCCATTGCCT | 17 | 59 |
| 434952 | N/A | N/A | 18834 | 18853 | ATCTAAGGCAAGCTGAATGC | 67 | 60 |
| 434953 | N/A | N/A | 18839 | 18858 | ACAGCATCTAAGGCAAGCTG | 38 | 61 |
| 434954 | N/A | N/A | 18845 | 18864 | GAATTTACAGCATCTAAGGC | 52 | 62 |
| 434955 | N/A | N/A | 18850 | 18869 | TTCCTGAATTTACAGCATCT | 21 | 63 |
| 434957 | N/A | N/A | 5359 | 5378 | GCCGGAGACCTTGAAGAGCG | 94 | 64 |
| 434958 | N/A | N/A | 7480 | 7499 | ACTGGTCAGAATCTTGAAAA | 94 | 65 |
| 434959 | N/A | N/A | 9101 | 9120 | GTTGTGAACCTGCTAAAGGA | 90 | 66 |
| 434960 | N/A | N/A | 10818 | 10837 | CCTGGCAACCTGCATTTGCA | 43 | 67 |
| 434961 | N/A | N/A | 10823 | 10842 | TGTCACCTGGCAACCTGCAT | 45 | 68 |
| 434962 | N/A | N/A | 12030 | 12049 | GGGCAGGTTTCATTTCATTT | 33 | 69 |
| 434963 | N/A | N/A | 13414 | 13433 | GCCGGCAGTCTGCAAACACA | 58 | 70 |
| 434964 | N/A | N/A | 19448 | 19467 | CAGAGGTTCTACCTTTAATA | 50 | 71 |

Example 2: Effect of 3-10-3 cEt Gapmers with Phosphorothioate Internucleoside Linkages on Human IRF4 In Vitro, Single Dose Modified oligonucleotides complementary to a human IRF4 nucleic acid were designed and tested for their effect on IRF4 mRNA in vitro.

Cultured SK-MEL-28 cells at a density of 20,000 cells per well were transfected using electroporation with 4,000 nM concentration of modified oligonucleotide or no modified oligonucleotide for untreated controls. After approximately 24 hours, RNA was isolated from the cells and IRF4 mRNA levels were measured by quantitative real-time PCR. Human primer probe set RTS3114 (described hereinabove in Example 1) was used to measure mRNA levels. IRF4 mRNA levels were adjusted according to total RNA content, as measured by RIBOGREEN®. Results are presented in the table below as percent control of the amount of IRF4 mRNA, relative to untreated control (UTC) cells.

The modified oligonucleotides in Tables 2 and 3 are 3-10-3 cEt gapmers. The gapmers are 16 nucleobases in length, wherein the central gap segment comprises ten 2'-deoxynucleosides and is flanked by wing segments on both the 5' end and on the 3' end comprising three cEt nucleosides. The sugar motif for the gapmers is (from 5' to 3'): kkkddddddddddkkk; wherein 'd' represents a 2'-deoxyribose sugar and 'k' represents a cEt modified sugar. Each internucleoside linkage is a phosphorothioate internucleoside linkage and each cytosine residue is a 5-methylcytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Tables 2 and 3 below is complementary to human IRF4 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to human IRF4 reduced the amount of human IRF4 mRNA.

TABLE 2

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609281 | 156 | 171 | 5183 | 5198 | GCTCATGCCGAACTCT | 81 | 72 |
| 609282 | 213 | 228 | 5240 | 5255 | GCTGTCGATCTGGTCG | 91 | 73 |
| 609283 | 216 | 231 | 5243 | 5258 | GCCGCTGTCGATCTGG | 76 | 74 |
| 609284 | 219 | 234 | 5246 | 5261 | CTTGCCGCTGTCGATC | 75 | 75 |
| 609285 | 222 | 237 | 5249 | 5264 | GTACTTGCCGCTGTCG | 73 | 76 |
| 609286 | 238 | 253 | 5265 | 5280 | CCCACACCAGCCCGGG | 106 | 77 |
| 609287 | 241 | 256 | 5268 | 5283 | TCTCCCACACCAGCCC | 94 | 78 |
| 609288 | 244 | 259 | 5271 | 5286 | CGTTCTCCCACACCAG | 52 | 79 |
| 609289 | 294 | 309 | 5321 | 5336 | GTCCTGCTTGCCCGCG | 69 | 80 |
| 609290 | 297 | 312 | 5324 | 5339 | GTAGTCCTGCTTGCCC | 56 | 81 |
| 609291 | 334 | 349 | N/A | N/A | CCCAAGCCTTGAAGAG | 94 | 82 |
| 609292 | 431 | 446 | 6910 | 6925 | AAGTCATTGCTCTTGT | 72 | 83 |
| 609293 | 434 | 449 | 6913 | 6928 | TCAAAGTCATTGCTCT | 79 | 84 |
| 609294 | 437 | 452 | 6916 | 6931 | TCCTCAAAGTCATTGC | 68 | 85 |
| 609295 | 496 | 511 | 6975 | 6990 | GAACAATCCTGTACAC | 105 | 86 |
| 609296 | 514 | 529 | 6993 | 7008 | CTTTTTTGGCTCCCTC | 64 | 87 |
| 609297 | 517 | 532 | N/A | N/A | CTCCTTTTTGGCTCC | 81 | 88 |
| 609298 | 610 | 625 | N/A | N/A | GAACCTGCTGGGCTGG | 64 | 89 |
| 609299 | 730 | 745 | 9220 | 9235 | CTTGCCAGTGGTGGCC | 84 | 90 |
| 609300 | 733 | 748 | 9223 | 9238 | GGCCTTGCCAGTGGTG | 112 | 91 |
| 609301 | 752 | 767 | N/A | N/A | CAACCATTTTCACAAG | 83 | 92 |
| 609302 | 755 | 770 | N/A | N/A | TGGCAACCATTTTCAC | 93 | 93 |
| 609303 | 758 | 773 | N/A | N/A | ACCTGGCAACCATTTT | 96 | 94 |
| 609304 | 761 | 776 | N/A | N/A | GTCACCTGGCAACCAT | 59 | 95 |
| 609305 | 764 | 779 | 10829 | 10844 | CCTGTCACCTGGCAAC | 59 | 96 |
| 609306 | 767 | 782 | 10832 | 10847 | GTTCCTGTCACCTGGC | 51 | 97 |
| 609307 | 770 | 785 | 10835 | 10850 | AAGGTTCCTGTCACCT | 102 | 98 |
| 609308 | 773 | 788 | 10838 | 10853 | TAAAGGTTCCTGTCA | 94 | 99 |
| 609309 | 776 | 791 | 10841 | 10856 | GCATAAAAGGTTCCTG | 74 | 100 |
| 609310 | 780 | 795 | 10845 | 10860 | ACAAGCATAAAAGGTT | 96 | 101 |

TABLE 2-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609311 | 799 | 814 | 10864 | 10879 | CCTGGGACTCAGGTGG | 41 | 102 |
| 609312 | 802 | 817 | 10867 | 10882 | GAGCCTGGGACTCAGG | 51 | 103 |
| 609313 | 832 | 847 | 10897 | 10912 | ACCTTATGCTTGGCTC | 69 | 104 |
| 609314 | 835 | 850 | 10900 | 10915 | CAGACCTTATGCTTGG | 90 | 105 |
| 609317 | 943 | 958 | 13496 | 13511 | GGGAGATCCGGCAGCC | 110 | 106 |
| 609318 | 979 | 994 | 13532 | 13547 | CCTGGTCCAGGTTGCT | 74 | 107 |
| 609319 | 982 | 997 | 13535 | 13550 | GGACCTGGTCCAGGTT | 102 | 108 |
| 609320 | 985 | 1000 | 13538 | 13553 | ACAGGACCTGGTCCAG | 65 | 109 |
| 609321 | 1046 | 1061 | 13599 | 13614 | TCCAGGTGGCTCAGCA | 59 | 110 |
| 609322 | 1049 | 1064 | 13602 | 13617 | CTCTCCAGGTGGCTCA | 87 | 111 |
| 609323 | 1052 | 1067 | 13605 | 13620 | CCCCTCTCCAGGTGGC | 87 | 112 |
| 609324 | 1194 | 1209 | 13747 | 13762 | TGTGTCAAAGAGCTTG | 78 | 113 |
| 609325 | 1198 | 1213 | 13751 | 13766 | GCTGTGTGTCAAAGAG | 94 | 114 |
| 609326 | 1201 | 1216 | 13754 | 13769 | ACTGCTGTGTGTCAAA | 106 | 115 |
| 609327 | 1264 | 1279 | 17057 | 17072 | GAGTCACCTGGAATCT | 57 | 116 |
| 609328 | 1291 | 1306 | 17084 | 17099 | GGTCTGGAAACTCCTC | 48 | 117 |
| 609329 | 1294 | 1309 | 17087 | 17102 | GAGGGTCTGGAAACTC | 104 | 118 |
| 609330 | 1297 | 1312 | 17090 | 17105 | TCTGAGGGTCTGGAAA | 91 | 119 |
| 609331 | 1321 | 1336 | 17114 | 17129 | GAGCTGTGATGAGCTT | 90 | 120 |
| 609332 | 1342 | 1357 | 19459 | 19474 | TGGCTAGCAGAGGTTC | 44 | 121 |
| 609333 | 1345 | 1360 | 19462 | 19477 | GTCTGGCTAGCAGAGG | 34 | 122 |
| 609334 | 1348 | 1363 | 19465 | 19480 | GTTGTCTGGCTAGCAG | 41 | 123 |
| 609335 | 1389 | 1404 | 19506 | 19521 | CCTCAGGAAATGTCCA | 63 | 124 |
| 609336 | 1393 | 1408 | 19510 | 19525 | AGCCCCTCAGGAAATG | 76 | 125 |
| 609337 | 2068 | 2083 | 20185 | 20200 | CTTCCCTGAGAAATGG | 50 | 126 |
| 609338 | 2071 | 2086 | 20188 | 20203 | TTACTTCCCTGAGAAA | 80 | 127 |
| 609339 | 2719 | 2734 | 20836 | 20851 | AATAAGCAGAAACAGC | 101 | 128 |
| 609340 | 3533 | 3548 | 21650 | 21665 | ATCTATAAGATGTATA | 101 | 129 |
| 609341 | 3536 | 3551 | 21653 | 21668 | TGCATCTATAAGATGT | 68 | 130 |
| 609342 | 3803 | 3818 | 21920 | 21935 | TCCAGAAAATTCAGCT | 52 | 131 |
| 609343 | 3809 | 3824 | 21926 | 21941 | GCATTTTCCAGAAAAT | 36 | 132 |
| 609344 | N/A | N/A | 6995 | 7010 | ACCTTTTTTGGCTCCC | 79 | 133 |
| 609345 | N/A | N/A | 7740 | 7755 | ATTCTTAGAATGCATA | 62 | 134 |
| 609346 | N/A | N/A | 8504 | 8519 | CAAACTCCTCAGGGAA | 77 | 135 |
| 609347 | N/A | N/A | 9242 | 9257 | TTACCATTTTCACAAG | 92 | 136 |
| 609348 | N/A | N/A | 10796 | 10811 | AATCAGATGATGTCTA | 103 | 137 |
| 609349 | N/A | N/A | 10813 | 10828 | CTGCATTTGCAAATAA | 121 | 138 |

TABLE 2-continued

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609350 | N/A | N/A | 10819 | 10834 | GGCAACCTGCATTTGC | 113 | 139 |
| 609351 | N/A | N/A | 10825 | 10840 | TCACCTGGCAACCTGC | 75 | 140 |
| 609352 | N/A | N/A | 11951 | 11966 | CACCCACACAAGTCTT | 91 | 141 |
| 609353 | N/A | N/A | 11972 | 11987 | GTTTATTTCCTACTCT | 84 | 142 |
| 609354 | N/A | N/A | 11978 | 11993 | ATAGCTGTTTATTTCC | 38 | 143 |
| 609355 | N/A | N/A | 11985 | 12000 | GATATAAATAGCTGTT | 63 | 144 |
| 609356 | N/A | N/A | 12024 | 12039 | CATTTCATTTAATGTC | 67 | 145 |
| 609357 | N/A | N/A | 12031 | 12046 | CAGGTTTCATTTCATT | 40 | 146 |
| 609358 | N/A | N/A | 13795 | 13810 | CCTCCATTCTAACAGA | 118 | 147 |

TABLE 3

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609360 | 4711 | 4726 | 22828 | 22843 | TGGCCACAGAGGACTT | 67 | 148 |
| 609361 | 1 | 16 | 3740 | 3755 | ACTGAGAGTGCGAGGT | 120 | 149 |
| 609362 | 121 | 136 | 5148 | 5163 | CCAGGTTCATGCCCCG | 46 | 150 |
| 609363 | 181 | 196 | 5208 | 5223 | GCTTCCCGTTGCCGCA | 82 | 151 |
| 609364 | 300 | 315 | 5327 | 5342 | GTTGTAGTCCTGCTTG | 78 | 152 |
| 609365 | 420 | 435 | 6899 | 6914 | CTTGTTCAAAGCGCAC | 68 | 153 |
| 609366 | 480 | 495 | 6959 | 6974 | TTTGTACGGGTCTGAG | 80 | 154 |
| 609367 | 672 | 687 | 9162 | 9177 | GTGTGGCTGATCCGGG | 73 | 155 |
| 609368 | 736 | 751 | 9226 | 9241 | CTGGGCCTTGCCAGTG | 114 | 156 |
| 609369 | 810 | 825 | 10875 | 10890 | GACTCCGGGAGCCTGG | 35 | 157 |
| 609371 | 1004 | 1019 | 13557 | 13572 | TTGTCCTCTGGGTAGG | 70 | 158 |
| 609372 | 1124 | 1139 | 13677 | 13692 | CCGTCCCAGTAGATCC | 75 | 159 |
| 609373 | 1184 | 1199 | 13737 | 13752 | AGCTTGCAGGTCTGGT | 47 | 160 |
| 609374 | 1431 | 1446 | 19548 | 19563 | GTAATCTTCTGGATTG | 71 | 161 |
| 609375 | 1527 | 1542 | 19644 | 19659 | TCCCCGTATCAAAAAA | 112 | 162 |
| 609376 | 1682 | 1697 | 19799 | 19814 | CACTTGTCTTGGGTGG | 55 | 163 |
| 609377 | 1742 | 1757 | 19859 | 19874 | AACAGTAAGAGGGCAG | 37 | 164 |
| 609378 | 1866 | 1881 | 19983 | 19998 | GCAAAGCCACCCTTCC | 40 | 165 |
| 609379 | 1986 | 2001 | 20103 | 20118 | TCTTCCAGCAAGACCT | 72 | 166 |
| 609380 | 2111 | 2126 | 20228 | 20243 | ATACATTTCTTTTACG | 78 | 167 |
| 609381 | 2171 | 2186 | 20288 | 20303 | GATTCATTTCCTTCAC | 51 | 168 |
| 609382 | 2231 | 2246 | 20348 | 20363 | GAAACCGCTGGCAGGT | 50 | 169 |

TABLE 3-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609383 | 2295 | 2310 | 20412 | 20427 | TCCAGGAAAGGCCAAG | 51 | 170 |
| 609384 | 2304 | 2319 | 20421 | 20436 | TAACTGGCTTCCAGGA | 70 | 171 |
| 609385 | 2365 | 2380 | 20482 | 20497 | AAAAATGTCCCATCCA | 70 | 172 |
| 609386 | 2431 | 2446 | 20548 | 20563 | GTCAAAAGATGCAGA | 50 | 173 |
| 609387 | 2494 | 2509 | 20611 | 20626 | GATTTATGTTCCTTAA | 53 | 174 |
| 609388 | 2574 | 2589 | 20691 | 20706 | AACAAACAGAGGAGCG | 84 | 175 |
| 609389 | 2634 | 2649 | 20751 | 20766 | GCCTGGGAGTCCCCGG | 82 | 176 |
| 609390 | 2694 | 2709 | 20811 | 20826 | GTGCAGTTCCGTAGTC | 79 | 177 |
| 609391 | 2754 | 2769 | 20871 | 20886 | ACTATAATTGGCACGA | 31 | 178 |
| 609392 | 2816 | 2831 | 20933 | 20948 | TCTTTGGGATTCTATA | 40 | 179 |
| 609393 | 2936 | 2951 | 21053 | 21068 | GGAGTAATAGTAAATA | 64 | 180 |
| 609394 | 3081 | 3096 | 21198 | 21213 | CTGCTCACTAAGCTTG | 27 | 181 |
| 609395 | 3147 | 3162 | 21264 | 21279 | GTATTAATATTCTGAC | 37 | 182 |
| 609396 | 3216 | 3231 | 21333 | 21348 | GGAGATCCTTTTTATT | 68 | 183 |
| 609397 | 3336 | 3351 | 21453 | 21468 | GACTCCATGAGGTTTT | 30 | 184 |
| 609398 | 3437 | 3452 | 21554 | 21569 | GGGTACATGGCAGTGG | 32 | 185 |
| 609399 | 3591 | 3606 | 21708 | 21723 | GCAGTTCTTAATATCA | 40 | 186 |
| 609400 | 3657 | 3672 | 21774 | 21789 | TGAAGTGCTGTGTGGG | 43 | 187 |
| 609401 | 3717 | 3732 | 21834 | 21849 | TCCGCTTGGAGAATTA | 87 | 188 |
| 609402 | 3782 | 3797 | 21899 | 21914 | GTTAAAGCAGCATAAT | 73 | 189 |
| 609403 | 3851 | 3866 | 21968 | 21983 | AGATGTAAAGATAGGA | 46 | 190 |
| 609404 | 3911 | 3926 | 22028 | 22043 | AGTTCATTCCCTAGGT | 56 | 191 |
| 609405 | 3971 | 3986 | 22088 | 22103 | GTTCCTTTTCAGAGTC | 28 | 192 |
| 609406 | 4031 | 4046 | 22148 | 22163 | AGTACAAACTAAATTC | 76 | 193 |
| 609407 | 4166 | 4181 | 22283 | 22298 | GAGGTTTTCCTAAATA | 31 | 194 |
| 609408 | 4226 | 4241 | 22343 | 22358 | TTGTAAATGAGTCGGT | 21 | 195 |
| 609409 | 4359 | 4374 | 22476 | 22491 | CTGTAGGATTTTACAT | 76 | 196 |
| 609410 | 4479 | 4494 | 22596 | 22611 | CAGAGTTGTTCCACCC | 38 | 197 |
| 609411 | 4599 | 4614 | 22716 | 22731 | AATGAACGGAAGTTTA | 67 | 198 |
| 609412 | 4665 | 4680 | 22782 | 22797 | AACCAATCCCAACACT | 88 | 199 |
| 609413 | 4727 | 4742 | 22844 | 22859 | TTCAGACAGATGCAGC | 38 | 200 |
| 609414 | 4800 | 4815 | 22917 | 22932 | CAGTCTCAAAAACGGG | 49 | 201 |
| 609415 | 4862 | 4877 | 22979 | 22994 | ACCTTTACTTCATTCC | 36 | 202 |
| 609416 | 4987 | 5002 | 23104 | 23119 | ACGGGAATTTCCATTG | 33 | 203 |
| 609417 | 5037 | 5052 | 23154 | 23169 | AAGTGGACCCCATTGC | 69 | 204 |
| 609418 | 5077 | 5092 | 23194 | 23209 | TTCAGCAGAAAGTGGG | 52 | 205 |
| 609419 | 5146 | 5161 | 23263 | 23278 | CGCAGAGCCAGTAGGG | 33 | 206 |

TABLE 3-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609420 | N/A | N/A | 2604<br>2875 | 2619<br>2890 | AAAAGCCCAAAATAGG | 112 | 207 |
| 609421 | N/A | N/A | 8538<br>8746<br>8850<br>8902<br>9058 | 8553<br>8761<br>8865<br>8917<br>9073 | CTGGCATTGAGACGGG | 39 | 208 |
| 609422 | N/A | N/A | 8542<br>8750<br>8854<br>8906<br>9062 | 8557<br>8765<br>8869<br>8921<br>9077 | AGCACTGGCATTGAGA | 26 | 209 |
| 609423 | N/A | N/A | 8547<br>8703<br>8807<br>8963<br>9067 | 8562<br>8718<br>8822<br>8978<br>9082 | TAAGAAGCACTGGCAT | 74 | 210 |
| 609424 | N/A | N/A | 8552<br>8708<br>8812<br>8968<br>9072 | 8567<br>8723<br>8827<br>8983<br>9087 | TGAGATAAGAAGCACT | 80 | 211 |
| 609425 | N/A | N/A | 8560<br>8716<br>8820<br>8976<br>9080 | 8575<br>8731<br>8835<br>8991<br>9095 | GGAGAGGCTGAGATAA | 71 | 212 |
| 609426 | N/A | N/A | 8561<br>8613<br>8665<br>8717<br>8769<br>8821<br>8873<br>8925<br>8977<br>9029<br>9081 | 8576<br>8628<br>8680<br>8732<br>8784<br>8836<br>8888<br>8940<br>8992<br>9044<br>9096 | AGGAGAGGCTGAGATA | 79 | 213 |
| 609427 | N/A | N/A | 8565<br>8617<br>8669<br>8721<br>8773<br>8825<br>8877<br>8929<br>8981<br>9033<br>9085 | 8580<br>8632<br>8684<br>8736<br>8788<br>8840<br>8892<br>8944<br>8996<br>9048<br>9100 | GTGCAGGAGAGGCTGA | 68 | 214 |
| 609428 | N/A | N/A | 8567<br>8619<br>8671<br>8723<br>8775<br>8827<br>8879<br>8931<br>8983<br>9035<br>9087 | 8582<br>8634<br>8686<br>8738<br>8790<br>8842<br>8894<br>8946<br>8998<br>9050<br>9102 | GAGTGCAGGAGAGGCT | 69 | 215 |
| 609429 | N/A | N/A | 8568<br>8620<br>8672<br>8724<br>8776 | 8583<br>8635<br>8687<br>8739<br>8791 | GGAGTGCAGGAGAGGC | 84 | 216 |

TABLE 3-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| | | | 8828 | 8843 | | | |
| | | | 8880 | 8895 | | | |
| | | | 8932 | 8947 | | | |
| | | | 8984 | 8999 | | | |
| | | | 9036 | 9051 | | | |
| | | | 9088 | 9103 | | | |
| 609430 | N/A | N/A | 8572 | 8587 | TAAAGGAGTGCAGGAG | 107 | 217 |
| | | | 8624 | 8639 | | | |
| | | | 8676 | 8691 | | | |
| | | | 8728 | 8743 | | | |
| | | | 8780 | 8795 | | | |
| | | | 8832 | 8847 | | | |
| | | | 8884 | 8899 | | | |
| | | | 8936 | 8951 | | | |
| | | | 8988 | 9003 | | | |
| | | | 9040 | 9055 | | | |
| | | | 9092 | 9107 | | | |
| 609431 | N/A | N/A | 8573 | 8588 | GTAAAGGAGTGCAGGA | 91 | 218 |
| | | | 8625 | 8640 | | | |
| | | | 8677 | 8692 | | | |
| | | | 8729 | 8744 | | | |
| | | | 8833 | 8848 | | | |
| | | | 8885 | 8900 | | | |
| | | | 8937 | 8952 | | | |
| | | | 8989 | 9004 | | | |
| | | | 9041 | 9056 | | | |
| 609432 | N/A | N/A | 8575 | 8590 | GGGTAAAGGAGTGCAG | 81 | 219 |
| | | | 8627 | 8642 | | | |
| | | | 8679 | 8694 | | | |
| | | | 8731 | 8746 | | | |
| | | | 8835 | 8850 | | | |
| | | | 8887 | 8902 | | | |
| | | | 8939 | 8954 | | | |
| | | | 8991 | 9006 | | | |
| | | | 9043 | 9058 | | | |
| 609433 | N/A | N/A | 8590 | 8605 | CTGGCATCGAGACGGG | 53 | 220 |
| | | | 8642 | 8657 | | | |
| | | | 8694 | 8709 | | | |
| | | | 8798 | 8813 | | | |
| | | | 8954 | 8969 | | | |
| | | | 9006 | 9021 | | | |
| 609434 | N/A | N/A | 8593 | 8608 | GCACTGGCATCGAGAC | 43 | 221 |
| | | | 8645 | 8660 | | | |
| | | | 8697 | 8712 | | | |
| | | | 8807 | 8816 | | | |
| | | | 8957 | 8972 | | | |
| | | | 9009 | 9024 | | | |
| 609435 | N/A | N/A | 8596 | 8611 | GAAGCACTGGCATCGA | 56 | 222 |
| | | | 8648 | 8663 | | | |
| | | | 8700 | 8715 | | | |
| | | | 8804 | 8819 | | | |
| | | | 8960 | 8975 | | | |
| | | | 9012 | 9027 | | | |
| 609436 | N/A | N/A | 18852 | 18867 | CCTGAATTTACAGCAT | 60 | 223 |

Example 3: Effect of 4-8-4 cEt Gapmers with Phosphorothioate Internucleoside Linkages on Human IRF4 In Vitro, Single Dose Modified oligonucleotides complementary to a human IRF4 nucleic acid were designed and tested for their effect on IRF4 mRNA in vitro.

Cultured SK-MEL-28 cells at a density of 20,000 cells per well were transfected using electroporation with 4,000 nM concentration of modified oligonucleotide or no modified oligonucleotide for untreated controls. After approximately 24 hours, RNA was isolated from the cells and IRF4 mRNA levels were measured by quantitative real-time PCR. Human primer probe set RTS3114 (described hereinabove in Example 1) was used to measure mRNA levels. IRF4 mRNA levels were adjusted according to total RNA content, as measured by RIBOGREEN®. Results are presented in the table below as percent control of the amount of IRF4 mRNA, relative to untreated control (UTC) cells.

The modified oligonucleotides in Table 4 are 4-8-4 cEt gapmers. The gapmers are 16 nucleobases in length, wherein the central gap segment comprises eight 2'-deoxynucleosides and is flanked by wing segments on both the 5' end and on the 3' end comprising four cEt nucleosides. The sugar motif for the gapmers is (from 5' to 3'): kkkkddddddddkkkk; wherein 'd' represents a 2'-deoxyribose sugar and 'k' represents a cEt modified sugar. Each internucleoside linkage is a phosphorothioate internucleoside linkage and each cytosine residue is a 5-methylcytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Table 4 below is complementary to human IRF4 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to human IRF4 reduced the amount of human IRF4 mRNA.

TABLE 4

Percent control of human IRF4 mRNA with 4-8-4 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609518 | 156 | 171 | 5183 | 5198 | GCTCATGCCGAACTCT | 70 | 72 |
| 609519 | 213 | 228 | 5240 | 5255 | GCTGTCGATCTGGTCG | 94 | 73 |
| 609520 | 216 | 231 | 5243 | 5258 | GCCGCTGTCGATCTGG | 85 | 74 |
| 609521 | 219 | 234 | 5246 | 5261 | CTTGCCGCTGTCGATC | 58 | 75 |
| 609522 | 222 | 237 | 5249 | 5264 | GTACTTGCCGCTGTCG | 64 | 76 |
| 609523 | 238 | 253 | 5265 | 5280 | CCCACACCAGCCCGGG | 106 | 77 |
| 609524 | 241 | 256 | 5268 | 5283 | TCTCCCACACCAGCCC | 75 | 78 |
| 609525 | 244 | 259 | 5271 | 5286 | CGTTCTCCCACACCAG | 101 | 79 |
| 609526 | 294 | 309 | 5321 | 5336 | GTCCTGCTTGCCCGCG | 86 | 80 |
| 609527 | 297 | 312 | 5324 | 5339 | GTAGTCCTGCTTGCCC | 89 | 81 |
| 609528 | 334 | 349 | N/A | N/A | CCCAAGCCTTGAAGAG | 78 | 82 |
| 609529 | 431 | 446 | 6910 | 6925 | AAGTCATTGCTCTTGT | 72 | 83 |
| 609530 | 434 | 449 | 6913 | 6928 | TCAAAGTCATTGCTCT | 43 | 84 |
| 609531 | 437 | 452 | 6916 | 6931 | TCCTCAAAGTCATTGC | 90 | 85 |
| 609532 | 496 | 511 | 6975 | 6990 | GAACAATCCTGTACAC | 100 | 86 |
| 609533 | 514 | 529 | 6993 | 7008 | CTTTTTTGGCTCCCTC | 54 | 87 |
| 609534 | 517 | 532 | N/A | N/A | CTCCTTTTTTGGCTCC | 93 | 88 |
| 609535 | 610 | 625 | N/A | N/A | GAACCTGCTGGGCTGG | 87 | 89 |
| 609536 | 730 | 745 | 9220 | 9235 | CTTGCCAGTGGTGGCC | 109 | 90 |
| 609537 | 733 | 748 | 9223 | 9238 | GGCCTTGCCAGTGGTG | 94 | 91 |
| 609538 | 752 | 767 | N/A | N/A | CAACCATTTTCACAAG | 95 | 92 |
| 609539 | 755 | 770 | N/A | N/A | TGGCAACCATTTTCAC | 93 | 93 |
| 609540 | 758 | 773 | N/A | N/A | ACCTGGCAACCATTTT | 81 | 94 |
| 609541 | 761 | 776 | N/A | N/A | GTCACCTGGCAACCAT | 59 | 95 |
| 609542 | 764 | 779 | 10829 | 10844 | CCTGTCACCTGGCAAC | 63 | 96 |
| 609543 | 767 | 782 | 10832 | 10847 | GTTCCTGTCACCTGGC | 88 | 97 |
| 609544 | 770 | 785 | 10835 | 10850 | AAGGTTCCTGTCACCT | 86 | 98 |
| 609545 | 773 | 788 | 10838 | 10853 | TAAAAGGTTCCTGTCA | 57 | 99 |

TABLE 4-continued

Percent control of human IRF4 mRNA with 4-8-4 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609546 | 776 | 791 | 10841 | 10856 | GCATAAAAGGTTCCTG | 53 | 100 |
| 609547 | 780 | 795 | 10845 | 10860 | ACAAGCATAAAAGGTT | 60 | 101 |
| 609548 | 799 | 814 | 10864 | 10879 | CCTGGGACTCAGGTGG | 93 | 102 |
| 609549 | 802 | 817 | 10867 | 10882 | GAGCCTGGGACTCAGG | 81 | 103 |
| 609550 | 832 | 847 | 10897 | 10912 | ACCTTATGCTTGGCTC | 70 | 104 |
| 609551 | 835 | 850 | 10900 | 10915 | CAGACCTTATGCTTGG | 74 | 105 |
| 609554 | 943 | 958 | 13496 | 13511 | GGGAGATCCGGCAGCC | 113 | 106 |
| 609555 | 979 | 994 | 13532 | 13547 | CCTGGTCCAGGTTGCT | 66 | 107 |
| 609556 | 982 | 997 | 13535 | 13550 | GGACCTGGTCCAGGTT | 128 | 108 |
| 609557 | 985 | 1000 | 13538 | 13553 | ACAGGACCTGGTCCAG | 93 | 109 |
| 609558 | 1046 | 1061 | 13599 | 13614 | TCCAGGTGGCTCAGCA | 66 | 110 |
| 609559 | 1049 | 1064 | 13602 | 13617 | CTCTCCAGGTGGCTCA | 88 | 111 |
| 609560 | 1052 | 1067 | 13605 | 13620 | CCCCTCTCCAGGTGGC | 101 | 112 |
| 609561 | 1194 | 1209 | 13747 | 13762 | TGTGTCAAAGAGCTTG | 74 | 113 |
| 609562 | 1198 | 1213 | 13751 | 13766 | GCTGTGTGTCAAAGAG | 60 | 114 |
| 609563 | 1201 | 1216 | 13754 | 13769 | ACTGCTGTGTGTCAAA | 81 | 115 |
| 609564 | 1264 | 1279 | 17057 | 17072 | GAGTCACCTGGAATCT | 94 | 116 |
| 609565 | 1291 | 1306 | 17084 | 17099 | GGTCTGGAAACTCCTC | 69 | 117 |
| 609566 | 1294 | 1309 | 17087 | 17102 | GAGGGTCTGGAAACTC | 92 | 118 |
| 609567 | 1297 | 1312 | 17090 | 17105 | TCTGAGGGTCTGGAAA | 97 | 119 |
| 609568 | 1321 | 1336 | 17114 | 17129 | GAGCTGTGATGAGCTT | 95 | 120 |
| 609569 | 1342 | 1357 | 19459 | 19474 | TGGCTAGCAGAGGTTC | 91 | 121 |
| 609570 | 1345 | 1360 | 19462 | 19477 | GTCTGGCTAGCAGAGG | 91 | 122 |
| 609571 | 1348 | 1363 | 19465 | 19480 | GTTGTCTGGCTAGCAG | 48 | 123 |
| 609572 | 1389 | 1404 | 19506 | 19521 | CCTCAGGAAATGTCCA | 90 | 124 |
| 609574 | 2068 | 2083 | 20185 | 20200 | CTTCCCTGAGAAATGG | 64 | 126 |
| 609575 | 2071 | 2086 | 20188 | 20203 | TTACTTCCCTGAGAAA | 86 | 127 |
| 609576 | 2719 | 2734 | 20836 | 20851 | AATAAGCAGAAACAGC | 61 | 128 |
| 609577 | 3533 | 3548 | 21650 | 21665 | ATCTATAAGATGTATA | 64 | 129 |
| 609578 | 3536 | 3551 | 21653 | 21668 | TGCATCTATAAGATGT | 90 | 130 |
| 609579 | 3803 | 3818 | 21920 | 21935 | TCCAGAAAATTCAGCT | 74 | 131 |
| 609580 | 3809 | 3824 | 21926 | 21941 | GCATTTTCCAGAAAAT | 63 | 132 |
| 609581 | N/A | N/A | 6995 | 7010 | ACCTTTTTTGGCTCCC | 81 | 133 |
| 609582 | N/A | N/A | 7740 | 7755 | ATTCTTAGAATGCATA | 67 | 134 |
| 609583 | N/A | N/A | 8504 | 8519 | CAAACTCCTCAGGGAA | 83 | 135 |
| 609584 | N/A | N/A | 9242 | 9257 | TTACCATTTTCACAAG | 93 | 136 |

TABLE 4-continued

Percent control of human IRF4 mRNA with 4-8-4 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609585 | N/A | N/A | 10796 | 10811 | AATCAGATGATGTCTA | 113 | 137 |
| 609586 | N/A | N/A | 10813 | 10828 | CTGCATTTGCAAATAA | 108 | 138 |
| 609587 | N/A | N/A | 10819 | 10834 | GGCAACCTGCATTTGC | 112 | 139 |
| 609588 | N/A | N/A | 10825 | 10840 | TCACCTGGCAACCTGC | 72 | 140 |
| 609589 | N/A | N/A | 11951 | 11966 | CACCCACACAAGTCTT | 86 | 141 |
| 609590 | N/A | N/A | 11972 | 11987 | GTTTATTTCCTACTCT | 56 | 142 |
| 609591 | N/A | N/A | 11978 | 11993 | ATAGCTGTTTATTTCC | 41 | 143 |
| 609592 | N/A | N/A | 11985 | 12000 | GATATAAATAGCTGTT | 39 | 144 |
| 609593 | N/A | N/A | 12024 | 12039 | CATTTCATTTAATGTC | 56 | 145 |
| 609594 | N/A | N/A | 12031 | 12046 | CAGGTTTCATTTCATT | 46 | 146 |
| 609595 | N/A | N/A | 13795 | 13810 | CCTCCATTCTAACAGA | 122 | 147 |

Example 4: Effect of 3-10-3 cEt Gapmers with Phosphorothioate Internucleoside Linkages on Human IRF4 In Vitro, Single Dose Modified oligonucleotides complementary to a human IRF4 nucleic acid were designed and tested for their effect on IRF4 mRNA in vitro.

Cultured SK-MEL-28 cells at a density of 20,000 cells per well were transfected using electroporation with 4,000 nM concentration of modified oligonucleotide or no modified oligonucleotide for untreated controls. After approximately 24 hours, RNA was isolated from the cells and IRF4 mRNA levels were measured by quantitative real-time PCR. Human primer probe set RTS3114 (described hereinabove in Example 1) was used to measure mRNA levels. IRF4 mRNA levels were adjusted according to total RNA content, as measured by RIBOGREEN®. Results are presented in the table below as percent control of the amount of IRF4 mRNA, relative to untreated control (UTC) cells.

The modified oligonucleotides in Tables 5 through 12 are 3-10-3 cEt gapmers. The gapmers are 16 nucleobases in length, wherein the central gap segment comprises ten 2'-deoxynucleosides and is flanked by wing segments on both the 5' end and on the 3' end comprising three cEt nucleosides. The sugar motif for the gapmers is (from 5' to 3'): kkkddddddddddkkk; wherein 'd' represents a 2'-deoxyribose sugar and 'k' represents a cEt modified sugar. Each internucleoside linkage is a phosphorothioate internucleoside linkage and each cytosine residue is a 5-methylcytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Tables 5 through 12 below is complementary to human IRF4 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to human IRF4 reduced the amount of human IRF4 mRNA.

TABLE 5

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 24 | 195 |
| 666225 | 5 | 20 | 3744 | 3759 | TGAAACTGAGAGTGCG | 81 | 224 |
| 666226 | 12 | 27 | 3751 | 3766 | CGAGCGGTGAAACTGA | 67 | 225 |
| 666227 | 19 | 34 | 3758 | 3773 | CCAAGATCGAGCGGTG | 63 | 226 |
| 666228 | 26 | 41 | 3765 | 3780 | GTGGGTCCCAAGATCG | 60 | 227 |
| 666229 | 40 | 55 | 3779 | 3794 | AGCTGAGGGCAGCGGT | 107 | 228 |

TABLE 5-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666230 | 47 | 62 | 3786 | 3801 | GACTCGGAGCTGAGGG | 77 | 229 |
| 666231 | 54 | 69 | 3793 | 3808 | CGCCCTGGACTCGGAG | 64 | 230 |
| 666232 | 61 | 76 | N/A | N/A | CTGCACTCGCCCTGGA | 58 | 231 |
| 666233 | 68 | 83 | N/A | N/A | CTCTGCTCTGCACTCG | 59 | 232 |
| 666234 | 75 | 90 | 5102 | 5117 | CCGCCCGCTCTGCTCT | 46 | 233 |
| 666235 | 82 | 97 | 5109 | 5124 | GGGTCCTCCGCCCGCT | 72 | 234 |
| 666236 | 101 | 116 | 5128 | 5143 | CCGTCCGCGCCCGCGC | 39 | 235 |
| 666237 | 129 | 144 | 5156 | 5171 | GCCGCCCTCCAGGTTC | 51 | 236 |
| 666238 | 136 | 151 | 5163 | 5178 | CTCGGCCGCCGCCCTC | 63 | 237 |
| 666239 | 143 | 158 | 5170 | 5185 | TCTCCGCCTCGGCCGC | 59 | 238 |
| 666240 | 150 | 165 | 5177 | 5192 | GCCGAACTCTCCGCCT | 49 | 239 |
| 666241 | 160 | 175 | 5187 | 5202 | CCGCGCTCATGCCGAA | 55 | 240 |
| 666242 | 167 | 182 | 5194 | 5209 | CAGCTCACCGCGCTCA | 58 | 241 |
| 666243 | 185 | 200 | 5212 | 5227 | CGGAGCTTCCCGTTGC | 65 | 242 |
| 666244 | 192 | 207 | 5219 | 5234 | CCACTGGCGGAGCTTC | 64 | 243 |
| 666245 | 304 | 319 | 5331 | 5346 | CGCGGTTGTAGTCCTG | 56 | 244 |
| 666246 | 311 | 326 | 5338 | 5353 | TCCTCCTCGCGGTTGT | 41 | 245 |
| 666247 | 327 | 342 | 5354 | 5369 | CTTGAAGAGCGCGGCG | 79 | 246 |
| 666248 | 338 | 353 | N/A | N/A | AGTGCCCAAGCCTTGA | 52 | 247 |
| 666249 | 348 | 363 | 6827 | 6842 | TCCTTTAAACAGTGCC | 50 | 248 |
| 666250 | 356 | 371 | 6835 | 6850 | CGGAACTTTCCTTTAA | 63 | 249 |
| 666251 | 363 | 378 | 6842 | 6857 | GCCTTCTCGGAACTTT | 68 | 250 |
| 666252 | 370 | 385 | 6849 | 6864 | TGTCGATGCCTTCTCG | 72 | 251 |
| 666253 | 377 | 392 | 6856 | 6871 | TCCGGCTTGTCGATGC | 59 | 252 |
| 666254 | 396 | 411 | 6875 | 6890 | CGTCTTCCAGGTGGGA | 84 | 253 |
| 666256 | 425 | 440 | 6904 | 6919 | TTGCTCTTGTTCAAAG | 71 | 254 |
| 666257 | 449 | 464 | 6928 | 6943 | CGCTCAACCAGTTCCT | 72 | 255 |
| 666258 | 456 | 471 | 6935 | 6950 | CTGGCTCCGCTCAACC | 48 | 256 |
| 666259 | 463 | 478 | 6942 | 6957 | TGTCCAGCTGGCTCCG | 61 | 257 |
| 666260 | 470 | 485 | 6949 | 6964 | TCTGAGATGTCCAGCT | 55 | 258 |
| 666261 | 484 | 499 | 6963 | 6978 | ACACTTTGTACGGGTC | 44 | 259 |
| 666262 | 507 | 522 | 6986 | 7001 | GGCTCCCTCAGGAACA | 81 | 260 |
| 666263 | 521 | 536 | N/A | N/A | TTGGCTCCTTTTTTGG | 87 | 261 |
| 666264 | 528 | 543 | 7846 | 7861 | GAGCTGCTTGGCTCCT | 81 | 262 |
| 666265 | 535 | 550 | 7853 | 7868 | CCAGGGTGAGCTGCTT | 69 | 263 |
| 666266 | 546 | 561 | 7864 | 7879 | CTGCGGGTCCTCCAGG | 80 | 264 |
| 666267 | 553 | 568 | 7871 | 7886 | TGGACATCTGCGGGTC | 56 | 265 |

TABLE 5-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666268 | 560 | 575 | 7878 | 7893 | TGGCTCATGGACATCT | 68 | 266 |
| 666269 | 577 | 592 | 7895 | 7910 | TTGTCATGGTGTAGGG | 59 | 267 |
| 666270 | 593 | 608 | 7911 | 7926 | AGCGAAGGGTAAGGCG | 86 | 268 |
| 666271 | 621 | 636 | 9111 | 9126 | CATGTAGTTGTGAACC | 73 | 269 |
| 666272 | 628 | 643 | 9118 | 9133 | GTGGCATCATGTAGTT | 73 | 270 |
| 666273 | 644 | 659 | 9134 | 9149 | CAGCTTCGGTCGAGGG | 42 | 271 |
| 666274 | 651 | 666 | 9141 | 9156 | GTCCCTCCAGCTTCGG | 97 | 272 |
| 666275 | 676 | 691 | 9166 | 9181 | CCGGGTGTGGCTGATC | 84 | 273 |
| 666276 | 695 | 710 | 9185 | 9200 | GGACATTGGTACGGGA | 50 | 274 |
| 666277 | 702 | 717 | 9192 | 9207 | CGTCATGGGACATTGG | 44 | 275 |
| 666278 | 725 | 740 | 9215 | 9230 | CAGTGGTGGCCGCGGG | 73 | 276 |
| 666279 | 740 | 755 | 9230 | 9245 | CAAGCTGGGCCTTGCC | 66 | 277 |
| 666280 | 747 | 762 | 9237 | 9252 | ATTTTCACAAGCTGGG | 61 | 278 |
| 666281 | 771 | 786 | 10836 | 10851 | AAAGGTTCCTGTCACC | 62 | 279 |
| 666282 | 775 | 790 | 10840 | 10855 | CATAAAAGGTTCCTGT | 91 | 280 |
| 666283 | 777 | 792 | 10842 | 10857 | AGCATAAAAGGTTCCT | 55 | 281 |
| 666284 | 779 | 794 | 10844 | 10859 | CAAGCATAAAAGGTTC | 71 | 282 |
| 666285 | 781 | 796 | 10846 | 10861 | CACAAGCATAAAAGGT | 74 | 283 |
| 666286 | 784 | 799 | 10849 | 10864 | GGGCACAAGCATAAAA | 80 | 284 |
| 666287 | 827 | 842 | 10892 | 10907 | ATGCTTGGCTCTGTGG | 24 | 285 |
| 666294 | 947 | 962 | 13500 | 13515 | CCATGGGAGATCCGGC | 46 | 286 |
| 666295 | 954 | 969 | 13507 | 13522 | CGTATGTCCATGGGAG | 12 | 287 |
| 666296 | 975 | 990 | 13528 | 13543 | GTCCAGGTTGCTGGCG | 47 | 288 |
| 666297 | 989 | 1004 | 13542 | 13557 | GGGAACAGGACCTGGT | 45 | 289 |
| 666298 | 1008 | 1023 | 13561 | 13576 | GCCATTGTCCTCTGGG | 75 | 290 |
| 666299 | 1015 | 1030 | 13568 | 13583 | TCCTCTGGCCATTGTC | 59 | 291 |
| 666300 | 1033 | 1048 | 13586 | 13601 | GCAGCTTCTCAATGTT | 57 | 292 |
| 666301 | 1042 | 1057 | 13595 | 13610 | GGTGGCTCAGCAGCTT | 63 | 293 |

TABLE 6

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 23 | 195 |
| 666302 | 1058 | 1073 | 13611 | 13626 | ACCACGCCCCTCTCCA | 91 | 294 |

TABLE 6-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666303 | 1065 | 1080 | 13618 | 13633 | CCAGAGGACCACGCCC | 72 | 295 |
| 666306 | 1101 | 1116 | 13654 | 13669 | GCACAGTCTTTTCGCA | 80 | 296 |
| 666307 | 1109 | 1124 | 13662 | 13677 | CTGCTCTGGCACAGTC | 17 | 297 |
| 666308 | 1116 | 1131 | 13669 | 13684 | GTAGATCCTGCTCTGG | 55 | 298 |
| 666309 | 1128 | 1143 | 13681 | 13696 | GGGCCCGTCCCAGTAG | 80 | 299 |
| 666311 | 1167 | 1182 | 13720 | 13735 | TCTCTCCAGTTTGTTG | 86 | 300 |
| 666312 | 1188 | 1203 | 13741 | 13756 | AAAGAGCTTGCAGGTC | 63 | 301 |
| 666313 | 1205 | 1220 | 13758 | 13773 | AAGAACTGCTGTGTGT | 88 | 302 |
| 666314 | 1212 | 1227 | N/A | N/A | CTCTGACAAGAACTGC | 70 | 303 |
| 666315 | 1219 | 1234 | N/A | N/A | CTTGCAGCTCTGACAA | 91 | 304 |
| 666317 | 1241 | 1256 | 17034 | 17049 | GAGCGGCCGTGGTGAG | 59 | 305 |
| 666318 | 1248 | 1263 | 17041 | 17056 | TGGCAGGGAGCGGCCG | 89 | 306 |
| 666319 | 1255 | 1270 | 17048 | 17063 | GGAATCTTGGCAGGGA | 52 | 307 |
| 666321 | 1275 | 1290 | 17068 | 17083 | TCCAAAGCATAGAGTC | 47 | 308 |
| 666322 | 1287 | 1302 | 17080 | 17095 | TGGAAACTCCTCTCCA | 84 | 309 |
| 666323 | 1311 | 1326 | 17104 | 17119 | GAGCTTTCTTTGCCTC | 87 | 310 |
| 666324 | 1338 | 1353 | N/A | N/A | TAGCAGAGGTTCTACG | 76 | 311 |
| 666326 | 1347 | 1362 | 19464 | 19479 | TTGTCTGGCTAGCAGA | 55 | 312 |
| 666327 | 1349 | 1364 | 19466 | 19481 | AGTTGTCTGGCTAGCA | 20 | 313 |
| 666328 | 1351 | 1366 | 19468 | 19483 | ATAGTTGTCTGGCTAG | 48 | 314 |
| 666329 | 1353 | 1368 | 19470 | 19485 | ATATAGTTGTCTGGCT | 59 | 315 |
| 666331 | 1381 | 1396 | 19498 | 19513 | AATGTCCACTGTTTTG | 53 | 316 |
| 666333 | 1417 | 1432 | 19534 | 19549 | TGCTGATGTGTTCTGG | 33 | 317 |
| 666335 | 1442 | 1457 | 19559 | 19574 | ATAGATCTGTGGTAAT | 62 | 318 |
| 666336 | 1449 | 1464 | 19566 | 19581 | ATGGCGGATAGATCTG | 43 | 319 |
| 666337 | 1456 | 1471 | 19573 | 19588 | TAGAGGAATGGCGGAT | 55 | 320 |
| 666338 | 1463 | 1478 | 19580 | 19595 | TCTTGAATAGAGGAAT | 58 | 321 |
| 666339 | 1485 | 1500 | 19602 | 19617 | CACTCATCTTGACATT | 64 | 322 |
| 666341 | 1538 | 1553 | 19655 | 19670 | AAGACCCCGTATCCCC | 58 | 323 |
| 666342 | 1686 | 1701 | 19803 | 19818 | AAATCACTTGTCTTGG | 51 | 324 |
| 666343 | 1715 | 1730 | 19832 | 19847 | CTTTCACTAAAGTCAA | 49 | 325 |
| 666344 | 1730 | 1745 | 19847 | 19862 | GCAGTCAATTGGACGC | 23 | 326 |
| 666345 | 1737 | 1752 | 19854 | 19869 | TAAGAGGGCAGTCAAT | 83 | 327 |
| 666346 | 1762 | 1777 | 19879 | 19894 | TCCACTTCTGAATTCC | 81 | 328 |
| 666347 | 1775 | 1790 | 19892 | 19907 | CTGAACTGAAATCTCC | 36 | 329 |
| 666348 | 1782 | 1797 | 19899 | 19914 | TCAACCGCTGAACTGA | 65 | 330 |
| 666349 | 1789 | 1804 | 19906 | 19921 | ATTCTCCTCAACCGCT | 65 | 331 |

TABLE 6-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666351 | 1803 | 1818 | 19920 | 19935 | CTTGTCTCGCCGCAAT | 35 | 332 |
| 666352 | 1810 | 1825 | 19927 | 19942 | TTCCATGCTTGTCTCG | 38 | 333 |
| 666353 | 1826 | 1841 | 19943 | 19958 | TCAGATGTCACTGATT | 65 | 334 |
| 666354 | 1840 | 1855 | 19957 | 19972 | AGCTCATCTGCCAATC | 67 | 335 |
| 666355 | 1848 | 1863 | 19965 | 19980 | TTGAAATAAGCTCATC | 67 | 336 |
| 666356 | 1885 | 1900 | 20002 | 20017 | TCTACAGAACACAAGA | 108 | 337 |
| 666357 | 1892 | 1907 | 20009 | 20024 | ATGGCAGTCTACAGAA | 102 | 338 |
| 666358 | 1899 | 1914 | 20016 | 20031 | ATCAATGATGGCAGTC | 43 | 339 |
| 666359 | 1908 | 1923 | 20025 | 20040 | ACAGTGATCATCAATG | 44 | 340 |
| 666360 | 1915 | 1930 | 20032 | 20047 | AATTTTCACAGTGATC | 66 | 341 |
| 666361 | 1922 | 1937 | 20039 | 20054 | CTTGGTCAATTTTCAC | 47 | 342 |
| 666362 | 1929 | 1944 | 20046 | 20061 | CACATCACTTGGTCAA | 28 | 343 |
| 666363 | 1956 | 1971 | 20073 | 20088 | TAAAGAGCGCATTTCA | 59 | 344 |
| 666364 | 1963 | 1978 | 20080 | 20095 | AACAAATTAAAGAGCG | 77 | 345 |
| 666365 | 1972 | 1987 | 20089 | 20104 | CTAATCTACAACAAAT | 77 | 346 |
| 666366 | 2000 | 2015 | 20117 | 20132 | GCAAGTTTTCTCTGTC | 44 | 347 |
| 666368 | 2023 | 2038 | 20140 | 20155 | CTAGTCAGTGTCAATA | 49 | 348 |
| 666369 | 2030 | 2045 | 20147 | 20162 | CATCACTCTAGTCAGT | 41 | 349 |
| 666370 | 2037 | 2052 | 20154 | 20169 | AAGCAGTCATCACTCT | 62 | 350 |
| 666371 | 2053 | 2068 | 20170 | 20185 | GCACAGACATACCTAC | 54 | 351 |
| 666373 | 2082 | 2097 | 20199 | 20214 | CAATTTACATCTTACT | 79 | 352 |
| 666374 | 2089 | 2104 | 20206 | 20221 | GCTTCTTCAATTTACA | 55 | 353 |
| 666375 | 2130 | 2145 | 20247 | 20262 | GCAGCTCCTACATACA | 47 | 354 |
| 666376 | 2138 | 2153 | 20255 | 20270 | CAAGAACTGCAGCTCC | 53 | 355 |
| 666377 | 2146 | 2161 | 20263 | 20278 | GTCTTCCACAAGAACT | 53 | 356 |
| 666378 | 2153 | 2168 | 20270 | 20285 | AGCAAGTGTCTTCCAC | 25 | 357 |

TABLE 7

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 23 | 195 |
| 666379 | 2161 | 2176 | 20278 | 20293 | CTTCACTCAGCAAGTG | 57 | 358 |
| 666380 | 2179 | 2194 | 20296 | 20311 | CAGTCAAAGATTCATT | 60 | 359 |
| 666381 | 2193 | 2208 | 20310 | 20325 | TACAGGCACGGCTTCA | 42 | 360 |

TABLE 7-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666382 | 2200 | 2215 | 20317 | 20332 | CCAAGGCTACAGGCAC | 37 | 361 |
| 666383 | 2207 | 2222 | 20324 | 20339 | GGCCTCCCCAAGGCTA | 82 | 362 |
| 666384 | 2235 | 2250 | 20352 | 20367 | CCAGGAAACCGCTGGC | 62 | 363 |
| 666385 | 2243 | 2258 | 20360 | 20375 | GACCCACACCAGGAAA | 98 | 364 |
| 666386 | 2250 | 2265 | 20367 | 20382 | GCAGAGGGACCCACAC | 79 | 365 |
| 666387 | 2308 | 2323 | 20425 | 20440 | TTACTAACTGGCTTCC | 51 | 366 |
| 666388 | 2315 | 2330 | 20432 | 20447 | AGGAAGTTTACTAACT | 42 | 367 |
| 666389 | 2328 | 2343 | 20445 | 20460 | GACTCAAGAAAATAGG | 36 | 368 |
| 666390 | 2335 | 2350 | 20452 | 20467 | GTTTTTTGACTCAAGA | 33 | 369 |
| 666392 | 2355 | 2370 | 20472 | 20487 | CATCCAAGAGTAGCGC | 27 | 370 |
| 666393 | 2376 | 2391 | 20493 | 20508 | GTAGGACAGACAAAAA | 77 | 371 |
| 666394 | 2383 | 2398 | 20500 | 20515 | CTAGATTGTAGGACAG | 52 | 372 |
| 666395 | 2390 | 2405 | 20507 | 20522 | GACATTACTAGATTGT | 30 | 373 |
| 666396 | 2397 | 2412 | 20514 | 20529 | TTACTTAGACATTACT | 52 | 374 |
| 666397 | 2404 | 2419 | 20521 | 20536 | TTAACCATTACTTAGA | 55 | 375 |
| 666398 | 2435 | 2450 | 20552 | 20567 | GAGGGTCAAAAAGATG | 67 | 376 |
| 666399 | 2450 | 2465 | 20567 | 20582 | GCATCTCTAAAGAATG | 39 | 377 |
| 666400 | 2461 | 2476 | 20578 | 20593 | GAAGAATTTTAGCATC | 44 | 378 |
| 666401 | 2468 | 2483 | 20585 | 20600 | TTTATGCGAAGAATTT | 67 | 379 |
| 666402 | 2475 | 2490 | 20592 | 20607 | CTTCTTCTTTATGCGA | 34 | 380 |
| 666403 | 2498 | 2513 | 20615 | 20630 | TTAAGATTTATGTTCC | 36 | 381 |
| 666404 | 2514 | 2529 | 20631 | 20646 | GGCAACAGTTCAAGTA | 43 | 382 |
| 666405 | 2521 | 2536 | 20638 | 20653 | ACAGAAGGGCAACAGT | 57 | 383 |
| 666406 | 2528 | 2543 | 20645 | 20660 | TACTTGGACAGAAGGG | 38 | 384 |
| 666407 | 2535 | 2550 | 20652 | 20667 | AGTTAAGTACTTGGAC | 58 | 385 |
| 666408 | 2542 | 2557 | 20659 | 20674 | AACAGATAGTTAAGTA | 81 | 386 |
| 666409 | 2578 | 2593 | 20695 | 20710 | GCCAAACAAACAGAGG | 78 | 387 |
| 666410 | 2585 | 2600 | 20702 | 20717 | CTGGACAGCCAAACAA | 79 | 388 |
| 666411 | 2592 | 2607 | 20709 | 20724 | CTGATCGCTGGACAGC | 80 | 389 |
| 666412 | 2599 | 2614 | 20716 | 20731 | GCCATGGCTGATCGCT | 70 | 390 |
| 666413 | 2606 | 2621 | 20723 | 20738 | TAGTGTCGCCATGGCT | 31 | 391 |
| 666414 | 2613 | 2628 | 20730 | 20745 | CCTCCTTTAGTGTCGC | 35 | 392 |
| 666415 | 2621 | 2636 | 20738 | 20753 | CGGCTCCTCCTCCTTT | 89 | 393 |
| 666416 | 2628 | 2643 | 20745 | 20760 | GAGTCCCCGGCTCCTC | 75 | 394 |
| 666417 | 2652 | 2667 | 20769 | 20784 | TCCTGGCAGTGCTCTC | 40 | 395 |
| 666418 | 2659 | 2674 | 20776 | 20791 | TGGTGGGTCCTGGCAG | 77 | 396 |
| 666420 | 2673 | 2688 | 20790 | 20805 | CATCCTGCTTCCAGTG | 70 | 397 |

TABLE 7-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666421 | 2681 | 2696 | 20798 | 20813 | GTCAGCTCCATCCTGC | 48 | 398 |
| 666422 | 2688 | 2703 | 20805 | 20820 | TTCCGTAGTCAGCTCC | 32 | 399 |
| 666423 | 2698 | 2713 | 20815 | 20830 | GAGTGTGCAGTTCCGT | 33 | 400 |
| 666424 | 2705 | 2720 | 20822 | 20837 | GCCCACTGAGTGTGCA | 90 | 401 |
| 666425 | 2714 | 2729 | 20831 | 20846 | GCAGAAACAGCCCACT | 59 | 402 |
| 666426 | 2737 | 2752 | 20854 | 20869 | GAAGCATAGAACAGAT | 49 | 403 |
| 666427 | 2744 | 2759 | 20861 | 20876 | GCACGAGGAAGCATAG | 42 | 404 |
| 666428 | 2749 | 2764 | 20866 | 20881 | AATTGGCACGAGGAAG | 72 | 405 |
| 666429 | 2751 | 2766 | 20868 | 20883 | ATAATTGGCACGAGGA | 33 | 406 |
| 666430 | 2753 | 2768 | 20870 | 20885 | CTATAATTGGCACGAG | 37 | 407 |
| 666431 | 2755 | 2770 | 20872 | 20887 | AACTATAATTGGCACG | 27 | 408 |
| 666432 | 2757 | 2772 | 20874 | 20889 | CAAACTATAATTGGCA | 47 | 409 |
| 666433 | 2759 | 2774 | 20876 | 20891 | GTCAAACTATAATTGG | 39 | 410 |
| 666434 | 2765 | 2780 | 20882 | 20897 | GGCCCTGTCAAACTAT | 60 | 411 |
| 666435 | 2772 | 2787 | 20889 | 20904 | ATTTTAAGGCCCTGTC | 66 | 412 |
| 666436 | 2779 | 2794 | 20896 | 20911 | CCAAGTAATTTTAAGG | 66 | 413 |
| 666437 | 2793 | 2808 | 20910 | 20925 | GCATTTGGAAAAAGCC | 29 | 414 |
| 666438 | 2810 | 2825 | 20927 | 20942 | GGATTCTATAAATAGA | 75 | 415 |
| 666439 | 2820 | 2835 | 20937 | 20952 | GAGGTCTTTGGGATTC | 26 | 416 |
| 666440 | 2827 | 2842 | 20944 | 20959 | GCAAGTGGAGGTCTTT | 26 | 417 |
| 666441 | 2834 | 2849 | 20951 | 20966 | TACTTAAGCAAGTGGA | 25 | 418 |
| 666442 | 2841 | 2856 | 20958 | 20973 | ATAGGTATACTTAAGC | 20 | 419 |
| 666443 | 2848 | 2863 | 20965 | 20980 | GTAAGTGATAGGTATA | 24 | 420 |
| 666444 | 2872 | 2887 | 20989 | 21004 | GTACTTTCTCAAAACC | 30 | 421 |
| 666445 | 2879 | 2894 | 20996 | 21011 | TACTGCTGTACTTTCT | 57 | 422 |
| 666446 | 2886 | 2901 | 21003 | 21018 | CCCAGTCTACTGCTGT | 34 | 423 |
| 666447 | 2902 | 2917 | 21019 | 21034 | GGCCTGGAGGTGACGC | 59 | 424 |
| 666448 | 2909 | 2924 | 21026 | 21041 | GAGAAACGGCCTGGAG | 56 | 425 |
| 666449 | 2916 | 2931 | 21033 | 21048 | GTAGTATGAGAAACGG | 17 | 426 |
| 666450 | 2923 | 2938 | 21040 | 21055 | ATATCCTGTAGTATGA | 43 | 427 |
| 666451 | 2930 | 2945 | 21047 | 21062 | ATAGTAAATATCCTGT | 64 | 428 |
| 666452 | 2940 | 2955 | 21057 | 21072 | CCTGGGAGTAATAGTA | 47 | 429 |
| 666453 | 2947 | 2962 | 21064 | 21079 | TGCTGATCCTGGGAGT | 21 | 430 |
| 666454 | 2954 | 2969 | 21071 | 21086 | AATCTTCTGCTGATCC | 28 | 431 |
| 666455 | 2961 | 2976 | 21078 | 21093 | GCTACGCAATCTTCTG | 42 | 432 |

TABLE 8

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 20 | 195 |
| 666457 | 2975 | 2990 | 21092 | 21107 | ACACACATTTGAGAGC | 34 | 433 |
| 666458 | 2992 | 3007 | 21109 | 21124 | CCATTAGAAAAGCAGG | 20 | 434 |
| 666459 | 3021 | 3036 | 21138 | 21153 | TAGGTGCTTGTTGAAT | 50 | 435 |
| 666460 | 3031 | 3046 | 21148 | 21163 | AGGCACTTACTAGGTG | 46 | 436 |
| 666461 | 3039 | 3054 | 21156 | 21171 | GATACAGCAGGCACTT | 37 | 437 |
| 666462 | 3046 | 3061 | 21163 | 21178 | ATGTAGGGATACAGCA | 26 | 438 |
| 666463 | 3053 | 3068 | 21170 | 21185 | CTGTGTAATGTAGGGA | 58 | 439 |
| 666464 | 3060 | 3075 | 21177 | 21192 | GGCTGAACTGTGTAAT | 28 | 440 |
| 666465 | 3067 | 3082 | 21184 | 21199 | TGATAAAGGCTGAACT | 59 | 441 |
| 666466 | 3074 | 3089 | 21191 | 21206 | CTAAGCTTGATAAAGG | 46 | 442 |
| 666467 | 3085 | 3100 | 21202 | 21217 | CTCACTGCTCACTAAG | 36 | 443 |
| 666468 | 3092 | 3107 | 21209 | 21224 | TTCAGTGCTCACTGCT | 31 | 444 |
| 666469 | 3099 | 3114 | 21216 | 21231 | ATAATGTTTCAGTGCT | 24 | 445 |
| 666470 | 3136 | 3151 | 21253 | 21268 | CTGACTTTAATATTAG | 44 | 446 |
| 666471 | 3178 | 3193 | 21295 | 21310 | GTCTTTTCTGTAGTTA | 10 | 447 |
| 666472 | 3192 | 3207 | 21309 | 21324 | GTTCTCTACTGTTTGT | 32 | 448 |
| 666473 | 3239 | 3254 | 21356 | 21371 | GGAGAATTTGGGCTGG | 25 | 449 |
| 666474 | 3246 | 3261 | 21363 | 21378 | TTAGAGAGGAGAATTT | 65 | 450 |
| 666475 | 3253 | 3268 | 21370 | 21385 | GACACTTTTAGAGAGG | 13 | 451 |
| 666476 | 3260 | 3275 | 21377 | 21392 | TCTTGTGGACACTTTT | 35 | 452 |
| 666477 | 3267 | 3282 | 21384 | 21399 | CACCCCTTCTTGTGGA | 60 | 453 |
| 666478 | 3274 | 3289 | 21391 | 21406 | GAATAAACACCCCTTC | 56 | 454 |
| 666479 | 3288 | 3303 | 21405 | 21420 | GAAATGTGTTGGAAGA | 32 | 455 |
| 666480 | 3335 | 3350 | 21452 | 21467 | ACTCCATGAGGTTTTC | 27 | 456 |
| 666481 | 3337 | 3352 | 21454 | 21469 | TGACTCCATGAGGTTT | 35 | 457 |
| 666482 | 3339 | 3354 | 21456 | 21471 | GATGACTCCATGAGGT | 33 | 458 |
| 666483 | 3341 | 3356 | 21458 | 21473 | AAGATGACTCCATGAG | 36 | 459 |
| 666485 | 3355 | 3370 | 21472 | 21487 | ATGAAAGTGTGTGCAA | 36 | 460 |
| 666486 | 3362 | 3377 | 21479 | 21494 | GCACTGCATGAAAGTG | 60 | 461 |
| 666487 | 3371 | 3386 | 21488 | 21503 | CTACAAAGAGCACTGC | 47 | 462 |
| 666488 | 3378 | 3393 | 21495 | 21510 | CTGTTAGCTACAAAGA | 44 | 463 |
| 666489 | 3385 | 3400 | 21502 | 21517 | ATCTTCACTGTTAGCT | 26 | 464 |
| 666490 | 3392 | 3407 | 21509 | 21524 | GAGGTAAATCTTCACT | 30 | 465 |
| 666491 | 3399 | 3414 | 21516 | 21531 | GCAGAACGAGGTAAAT | 38 | 466 |
| 666492 | 3406 | 3421 | 21523 | 21538 | CCTCTGAGCAGAACGA | 24 | 467 |
| 666493 | 3413 | 3428 | 21530 | 21545 | AGCAAGGCCTCTGAGC | 45 | 468 |

TABLE 8-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666494 | 3420 | 3435 | 21537 | 21552 | GCTCCACAGCAAGGCC | 42 | 469 |
| 666495 | 3427 | 3442 | 21544 | 21559 | CAGTGGAGCTCCACAG | 59 | 470 |
| 666496 | 3432 | 3447 | 21549 | 21564 | CATGGCAGTGGAGCTC | 13 | 471 |
| 666497 | 3434 | 3449 | 21551 | 21566 | TACATGGCAGTGGAGC | 29 | 472 |
| 666498 | 3436 | 3451 | 21553 | 21568 | GGTACATGGCAGTGGA | 13 | 473 |
| 666499 | 3438 | 3453 | 21555 | 21570 | TGGGTACATGGCAGTG | 26 | 474 |
| 666500 | 3440 | 3455 | 21557 | 21572 | ACTGGGTACATGGCAG | 41 | 475 |
| 666501 | 3442 | 3457 | 21559 | 21574 | CTACTGGGTACATGGC | 16 | 476 |
| 666502 | 3448 | 3463 | 21565 | 21580 | CAAACCCTACTGGGTA | 68 | 477 |
| 666503 | 3455 | 3470 | 21572 | 21587 | GAAATGTCAAACCCTA | 29 | 478 |
| 666504 | 3462 | 3477 | 21579 | 21594 | GGCTAATGAAATGTCA | 36 | 479 |
| 666505 | 3469 | 3484 | 21586 | 21601 | GTTGCATGGCTAATGA | 39 | 480 |
| 666506 | 3476 | 3491 | 21593 | 21608 | TATCCATGTTGCATGG | 39 | 481 |
| 666507 | 3491 | 3506 | 21608 | 21623 | CTGCTGCCCAATACAT | 53 | 482 |
| 666508 | 3498 | 3513 | 21615 | 21630 | ACACAGTCTGCTGCCC | 49 | 483 |
| 666509 | 3505 | 3520 | 21622 | 21637 | TCACGAAACACAGTCT | 32 | 484 |
| 666510 | 3512 | 3527 | 21629 | 21644 | CTGCAGTTCACGAAAC | 62 | 485 |
| 666511 | 3519 | 3534 | 21636 | 21651 | TACATCACTGCAGTTC | 32 | 486 |
| 666512 | 3526 | 3541 | 21643 | 21658 | AGATGTATACATCACT | 24 | 487 |
| 666513 | 3548 | 3563 | 21665 | 21680 | CCCAAAATACTTTGCA | 36 | 488 |
| 666514 | 3558 | 3573 | 21675 | 21690 | GATAATATACCCCAAA | 67 | 489 |
| 666515 | 3565 | 3580 | 21682 | 21697 | CCCTTAGGATAATATA | 51 | 490 |
| 666516 | 3572 | 3587 | 21689 | 21704 | TTATCTTCCCTTAGGA | 72 | 491 |
| 666517 | 3599 | 3614 | 21716 | 21731 | GTGAAACAGCAGTTCT | 38 | 492 |
| 666518 | 3606 | 3621 | 21723 | 21738 | GGGCCCCGTGAAACAG | 67 | 493 |
| 666519 | 3613 | 3628 | 21730 | 21745 | CAGGTAAGGGCCCCGT | 30 | 494 |
| 666520 | 3620 | 3635 | 21737 | 21752 | AGGGTCACAGGTAAGG | 32 | 495 |
| 666521 | 3627 | 3642 | 21744 | 21759 | AGCAAAGAGGGTCACA | 32 | 496 |
| 666522 | 3642 | 3657 | 21759 | 21774 | GGTTAAATATTCTTCA | 52 | 497 |
| 666523 | 3661 | 3676 | 21778 | 21793 | TCTTTGAAGTGCTGTG | 43 | 498 |
| 666524 | 3668 | 3683 | 21785 | 21800 | GACAGCTTCTTTGAAG | 64 | 499 |
| 666525 | 3675 | 3690 | 21792 | 21807 | CTTCCAAGACAGCTTC | 37 | 500 |
| 666526 | 3682 | 3697 | 21799 | 21814 | AGACAGACTTCCAAGA | 64 | 501 |
| 666527 | 3689 | 3704 | 21806 | 21821 | GCTCCTGAGACAGACT | 44 | 502 |
| 666528 | 3696 | 3711 | 21813 | 21828 | ACAGGGTGCTCCTGAG | 77 | 503 |
| 666529 | 3710 | 3725 | 21827 | 21842 | GGAGAATTAAGAAGAC | 68 | 504 |

TABLE 8-continued

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666530 | 3721 | 3736 | 21838 | 21853 | AGCATCCGCTTGGAGA | 63 | 505 |
| 666531 | 3728 | 3743 | 21845 | 21860 | GAAATGGAGCATCCGC | 68 | 506 |
| 666532 | 3735 | 3750 | 21852 | 21867 | AGCAATTGAAATGGAG | 78 | 507 |

TABLE 9

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 20 | 195 |
| 666533 | 3742 | 3757 | 21859 | 21874 | GTCACAAAGCAATTGA | 33 | 508 |
| 666534 | 3786 | 3801 | 21903 | 21918 | CACTGTTAAAGCAGCA | 19 | 509 |
| 666535 | 3793 | 3808 | 21910 | 21925 | TCAGCTCCACTGTTAA | 27 | 510 |
| 666537 | 3824 | 3839 | 21941 | 21956 | GGCCCCAGCCAAGAAG | 92 | 511 |
| 666538 | 3831 | 3846 | 21948 | 21963 | AGGTAGTGGCCCCAGC | 40 | 512 |
| 666539 | 3865 | 3880 | 21982 | 21997 | GTCAACATACACATAG | 42 | 513 |
| 666540 | 3886 | 3901 | 22003 | 22018 | GATCACTCAGAATTTT | 50 | 514 |
| 666541 | 3893 | 3908 | 22010 | 22025 | TACCCTGGATCACTCA | 35 | 515 |
| 666542 | 3900 | 3915 | 22017 | 22032 | TAGGTCATACCCTGGA | 28 | 516 |
| 666543 | 3907 | 3922 | 22024 | 22039 | CATTCCCTAGGTCATA | 46 | 517 |
| 666544 | 3915 | 3930 | 22032 | 22047 | AGCTAGTTCATTCCCT | 52 | 518 |
| 666545 | 3922 | 3937 | 22039 | 22054 | ATTTCATAGCTAGTTC | 56 | 519 |
| 666546 | 3929 | 3944 | 22046 | 22061 | CCTGAGTATTTCATAG | 58 | 520 |
| 666547 | 3936 | 3951 | 22053 | 22068 | TCCTAACCCTGAGTAT | 73 | 521 |
| 666548 | 3950 | 3965 | 22067 | 22082 | ACAAGTGCTAGGATTC | 33 | 522 |
| 666549 | 3957 | 3972 | 22074 | 22089 | TCCTGAGACAAGTGCT | 45 | 523 |
| 666550 | 3964 | 3979 | 22081 | 22096 | TTCAGAGTCCTGAGAC | 54 | 524 |
| 666551 | 3968 | 3983 | 22085 | 22100 | CCTTTTCAGAGTCCTG | 42 | 525 |
| 666552 | 3972 | 3987 | 22089 | 22104 | CGTTCCTTTTCAGAGT | 70 | 526 |
| 666553 | 3974 | 3989 | 22091 | 22106 | GCCGTTCCTTTTCAGA | 38 | 527 |
| 666554 | 3976 | 3991 | 22093 | 22108 | AAGCCGTTCCTTTTCA | 71 | 528 |
| 666555 | 3982 | 3997 | 22099 | 22114 | ATGAGGAAGCCGTTCC | 42 | 529 |
| 666556 | 3996 | 4011 | 22113 | 22128 | TATCAAGACAAGGAAT | 93 | 530 |
| 666557 | 4003 | 4018 | 22120 | 22135 | TCCACTTTATCAAGAC | 35 | 531 |
| 666559 | 4017 | 4032 | 22134 | 22149 | TCTAGTTTGCCAATTC | 38 | 532 |
| 666560 | 4024 | 4039 | 22141 | 22156 | ACTAAATTCTAGTTTG | 100 | 533 |
| 666561 | 4035 | 4050 | 22152 | 22167 | ACTGAGTACAAACTAA | 68 | 534 |

TABLE 9-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666562 | 4042 | 4057 | 22159 | 22174 | ACTGTCCACTGAGTAC | 39 | 535 |
| 666563 | 4049 | 4064 | 22166 | 22181 | CAACAGCACTGTCCAC | 57 | 536 |
| 666564 | 4056 | 4071 | 22173 | 22188 | AAATCTTCAACAGCAC | 55 | 537 |
| 666565 | 4063 | 4078 | 22180 | 22195 | AGTCCTCAAATCTTCA | 46 | 538 |
| 666566 | 4071 | 4086 | 22188 | 22203 | CTTTAACAAGTCCTCA | 48 | 539 |
| 666567 | 4078 | 4093 | 22195 | 22210 | CAGTGCTCTTTAACAA | 63 | 540 |
| 666568 | 4085 | 4100 | 22202 | 22217 | TATGACCCAGTGCTCT | 60 | 541 |
| 666569 | 4093 | 4108 | 22210 | 22225 | TTTTTCCATATGACCC | 25 | 542 |
| 666570 | 4107 | 4122 | 22224 | 22239 | GGAGACACATACATTT | 78 | 543 |
| 666571 | 4117 | 4132 | 22234 | 22249 | AATGCACCTGGGAGAC | 38 | 544 |
| 666572 | 4124 | 4139 | 22241 | 22256 | ACCAAGAAATGCACCT | 43 | 545 |
| 666573 | 4134 | 4149 | 22251 | 22266 | CAAGACATAAACCAAG | 49 | 546 |
| 666574 | 4169 | 4184 | 22286 | 22301 | CTTGAGGTTTTCCTAA | 60 | 547 |
| 666575 | 4171 | 4186 | 22288 | 22303 | TGCTTGAGGTTTTCCT | 20 | 548 |
| 666576 | 4177 | 4192 | 22294 | 22309 | AATTACTGCTTGAGGT | 42 | 549 |
| 666577 | 4185 | 4200 | 22302 | 22317 | GAGATATTAATTACTG | 37 | 550 |
| 666578 | 4192 | 4207 | 22309 | 22324 | GTTCCAGGAGATATTA | 48 | 551 |
| 666579 | 4199 | 4214 | 22316 | 22331 | CTATAGTGTTCCAGGA | 34 | 552 |
| 666580 | 4206 | 4221 | 22323 | 22338 | TGGTTCTCTATAGTGT | 29 | 553 |
| 666581 | 4213 | 4228 | 22330 | 22345 | GGTCACTTGGTTCTCT | 21 | 554 |
| 666582 | 4220 | 4235 | 22337 | 22352 | ATGAGTCGGTCACTTG | 22 | 555 |
| 666583 | 4221 | 4236 | 22338 | 22353 | AATGAGTCGGTCACTT | 54 | 556 |
| 666584 | 4223 | 4238 | 22340 | 22355 | TAAATGAGTCGGTCAC | 24 | 557 |
| 666585 | 4225 | 4240 | 22342 | 22357 | TGTAAATGAGTCGGTC | 31 | 558 |
| 666586 | 4227 | 4242 | 22344 | 22359 | GTTGTAAATGAGTCGG | 13 | 559 |
| 666587 | 4229 | 4244 | 22346 | 22361 | CAGTTGTAAATGAGTC | 11 | 560 |
| 666588 | 4231 | 4246 | 22348 | 22363 | TTCAGTTGTAAATGAG | 44 | 561 |
| 666589 | 4237 | 4252 | 22354 | 22369 | CTAGGTTTCAGTTGTA | 46 | 562 |
| 666590 | 4244 | 4259 | 22361 | 22376 | GGGCTTCCTAGGTTTC | 61 | 563 |
| 666591 | 4272 | 4287 | 22389 | 22404 | AACTCTCCTGTTTTCG | 58 | 564 |
| 666592 | 4279 | 4294 | 22396 | 22411 | GGCGACTAACTCTCCT | 37 | 565 |
| 666593 | 4286 | 4301 | 22403 | 22418 | TCTGTAGGGCGACTAA | 35 | 566 |
| 666594 | 4294 | 4309 | 22411 | 22426 | CTGGGTTTCTGTAGG | 52 | 567 |
| 666595 | 4301 | 4316 | 22418 | 22433 | AGTCTAGCTGGGTTTT | 37 | 568 |
| 666596 | 4308 | 4323 | 22425 | 22440 | ACCCAATAGTCTAGCT | 75 | 569 |
| 666598 | 4322 | 4337 | 22439 | 22454 | TCTTTTTAGTTCATAC | 74 | 570 |

TABLE 9-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666599 | 4330 | 4345 | 22447 | 22462 | GCACAGTCTCTTTTTA | 64 | 571 |
| 666600 | 4337 | 4352 | 22454 | 22469 | CACCATGGCACAGTCT | 21 | 572 |
| 666601 | 4344 | 4359 | 22461 | 22476 | TTTTTCTCACCATGGC | 26 | 573 |
| 666602 | 4365 | 4380 | 22482 | 22497 | ATTTCACTGTAGGATT | 62 | 574 |
| 666603 | 4372 | 4387 | 22489 | 22504 | GCTGCTCATTTCACTG | 59 | 575 |
| 666604 | 4379 | 4394 | 22496 | 22511 | TGTAAGGGCTGCTCAT | 51 | 576 |
| 666605 | 4386 | 4401 | 22503 | 22518 | ACAATACTGTAAGGGC | 25 | 577 |
| 666607 | 4407 | 4422 | 22524 | 22539 | ACCTACCTGCCCTTGG | 72 | 578 |
| 666608 | 4414 | 4429 | 22531 | 22546 | CACTAATACCTACCTG | 94 | 579 |
| 666609 | 4425 | 4440 | 22542 | 22557 | GCTTTTTCAAACACTA | 32 | 580 |

TABLE 10

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 25 | 195 |
| 666610 | 4434 | 4449 | 22551 | 22566 | CAAAGACCAGCTTTTT | 50 | 581 |
| 666611 | 4441 | 4456 | 22558 | 22573 | CCTCGCTCAAAGACCA | 50 | 582 |
| 666612 | 4448 | 4463 | 22565 | 22580 | TTTATGCCCTCGCTCA | 76 | 583 |
| 666613 | 4455 | 4470 | 22572 | 22587 | AGCTGTATTTATGCCC | 42 | 584 |
| 666614 | 4474 | 4489 | 22591 | 22606 | TTGTTCCACCCCTGGG | 53 | 585 |
| 666615 | 4483 | 4498 | 22600 | 22615 | CTCCCAGAGTTGTTCC | 66 | 586 |
| 666616 | 4491 | 4506 | 22608 | 22623 | ACCCAAGACTCCCAGA | 55 | 587 |
| 666617 | 4498 | 4513 | 22615 | 22630 | TGCGAGTACCCAAGAC | 41 | 588 |
| 666618 | 4505 | 4520 | 22622 | 22637 | CAAGAGGTGCGAGTAC | 78 | 589 |
| 666619 | 4520 | 4535 | 22637 | 22652 | GAGCATCAACAAAGCC | 42 | 590 |
| 666620 | 4527 | 4542 | 22644 | 22659 | CCTGGCGGAGCATCAA | 58 | 591 |
| 666621 | 4534 | 4549 | 22651 | 22666 | TGGCCTTCCTGGCGGA | 91 | 592 |
| 666622 | 4541 | 4556 | 22658 | 22673 | ACACAAGTGGCCTTCC | 69 | 593 |
| 666623 | 4575 | 4590 | 22692 | 22707 | CTGAATTGTTACTAAA | 79 | 594 |
| 666624 | 4582 | 4597 | 22699 | 22714 | ACTGGATCTGAATTGT | 43 | 595 |
| 666625 | 4589 | 4604 | 22706 | 22721 | AGTTTACACTGGATCT | 26 | 596 |
| 666626 | 4603 | 4618 | 22720 | 22735 | GAGCAATGAACGGAAG | 28 | 597 |
| 666627 | 4612 | 4627 | 22729 | 22744 | GTGACTGGAGAGCAAT | 26 | 598 |
| 666628 | 4641 | 4656 | 22758 | 22773 | AACTTTCACCTGTGGG | 50 | 599 |
| 666629 | 4669 | 4684 | 22786 | 22801 | CCTTAACCAATCCCAA | 57 | 600 |

TABLE 10-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666630 | 4676 | 4691 | 22793 | 22808 | ATAAAGACCTTAACCA | 73 | 601 |
| 666631 | 4686 | 4701 | 22803 | 22818 | CGTAATACAAATAAAG | 97 | 602 |
| 666632 | 4719 | 4734 | 22836 | 22851 | GATGCAGCTGGCCACA | 27 | 603 |
| 666633 | 4731 | 4746 | 22848 | 22863 | ACCATTCAGACAGATG | 70 | 604 |
| 666634 | 4738 | 4753 | 22855 | 22870 | TTCACGCACCATTCAG | 84 | 605 |
| 666635 | 4745 | 4760 | 22862 | 22877 | GAGAGCCTTCACGCAC | 77 | 606 |
| 666636 | 4752 | 4767 | 22869 | 22884 | AAGGTCTGAGAGCCTT | 83 | 607 |
| 666637 | 4759 | 4774 | 22876 | 22891 | GGTGTGTAAGGTCTGA | 59 | 608 |
| 666638 | 4766 | 4781 | 22883 | 22898 | ACAAAATGGTGTGTAA | 93 | 609 |
| 666639 | 4780 | 4795 | 22897 | 22912 | GTAAAACATAACTTAC | 92 | 610 |
| 666640 | 4807 | 4822 | 22924 | 22939 | TCGAGATCAGTCTCAA | 18 | 611 |
| 666641 | 4814 | 4829 | 22931 | 22946 | ACCTGCATCGAGATCA | 47 | 612 |
| 666642 | 4825 | 4840 | 22942 | 22957 | CAAGGAGATCCACCTG | 121 | 613 |
| 666643 | 4836 | 4851 | 22953 | 22968 | TATCAGGATCTCAAGG | 94 | 614 |
| 666644 | 4843 | 4858 | 22960 | 22975 | AACAGGCTATCAGGAT | 83 | 615 |
| 666645 | 4850 | 4865 | 22967 | 22982 | TTCCTGTAACAGGCTA | 23 | 616 |
| 666646 | 4866 | 4881 | 22983 | 22998 | ACTGACCTTTACTTCA | 57 | 617 |
| 666647 | 4898 | 4913 | 23015 | 23030 | CCTCAAAGCTGTGAAA | 80 | 618 |
| 666648 | 4905 | 4920 | 23022 | 23037 | GCATGTTCCTCAAAGC | 24 | 619 |
| 666649 | 4912 | 4927 | 23029 | 23044 | TTCTTATGCATGTTCC | 20 | 620 |
| 666650 | 4919 | 4934 | 23036 | 23051 | GCTACATTTCTTATGC | 80 | 621 |
| 666651 | 4927 | 4942 | 23044 | 23059 | CTACTTCAGCTACATT | 53 | 622 |
| 666652 | 4934 | 4949 | 23051 | 23066 | GTCCCCTCTACTTCAG | 59 | 623 |
| 666653 | 4949 | 4964 | 23066 | 23081 | TGGCCCTTCTCTCACG | 89 | 624 |
| 666654 | 4956 | 4971 | 23073 | 23088 | GCCGGCCTGGCCCTTC | 114 | 625 |
| 666655 | 4963 | 4978 | 23080 | 23095 | TTGGCCTGCCGGCCTG | 96 | 626 |
| 666656 | 4970 | 4985 | 23087 | 23102 | AGGAGGGTTGGCCTGC | 96 | 627 |
| 666657 | 4977 | 4992 | 23094 | 23109 | CCATTGGAGGAGGGTT | 68 | 628 |
| 666658 | 4982 | 4997 | 23099 | 23114 | AATTTCCATTGGAGGA | 67 | 629 |
| 666659 | 4984 | 4999 | 23101 | 23116 | GGAATTTCCATTGGAG | 56 | 630 |
| 666660 | 4986 | 5001 | 23103 | 23118 | CGGGAATTTCCATTGG | 50 | 631 |
| 666661 | 4988 | 5003 | 23105 | 23120 | CACGGGAATTTCCATT | 29 | 632 |
| 666662 | 4990 | 5005 | 23107 | 23122 | AACACGGGAATTTCCA | 27 | 633 |
| 666663 | 4992 | 5007 | 23109 | 23124 | GCAACACGGGAATTTC | 26 | 634 |
| 666664 | 5005 | 5020 | 23122 | 23137 | GTCTCAGTTTGAAGCA | 26 | 635 |
| 666665 | 5012 | 5027 | 23129 | 23144 | CCCATCTGTCTCAGTT | 34 | 636 |

TABLE 10-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666666 | 5019 | 5034 | 23136 | 23151 | GTTAAGTCCCATCTGT | 60 | 637 |
| 666667 | 5026 | 5041 | 23143 | 23158 | ATTGCCTGTTAAGTCC | 27 | 638 |
| 666668 | 5086 | 5101 | 23203 | 23218 | GGCAGTTCTTTCAGCA | 63 | 639 |
| 666669 | 5093 | 5108 | 23210 | 23225 | ACCTGCTGGCAGTTCT | 39 | 640 |
| 666670 | 5100 | 5115 | 23217 | 23232 | GGGTCCTACCTGCTGG | 64 | 641 |
| 666671 | 5124 | 5139 | 23241 | 23256 | CAAGCTTTCATTTGGG | 26 | 642 |
| 666672 | 5131 | 5146 | 23248 | 23263 | GGAAATTCAAGCTTTC | 36 | 643 |
| 666673 | 5147 | 5162 | 23264 | 23279 | ACGCAGAGCCAGTAGG | 50 | 644 |
| 666674 | 5149 | 5164 | 23266 | 23281 | AAACGCAGAGCCAGTA | 63 | 645 |
| 666675 | 5151 | 5166 | 23268 | 23283 | CAAAACGCAGAGCCAG | 42 | 646 |
| 666676 | 5171 | 5186 | 23288 | 23303 | TCCTTTCCTACAGATC | 67 | 647 |
| 666677 | 5179 | 5194 | 23296 | 23311 | GTGAAGCATCCTTTCC | 37 | 648 |
| 666678 | 5186 | 5201 | 23303 | 23318 | TCAGTTTGTGAAGCAT | 11 | 649 |
| 666679 | 5193 | 5208 | 23310 | 23325 | ATCTACCTCAGTTTGT | 58 | 650 |
| 666680 | 5200 | 5215 | 23317 | 23332 | TAGCATTATCTACCTC | 34 | 651 |
| 666681 | 5207 | 5222 | 23324 | 23339 | GACAGCATAGCATTAT | 23 | 652 |
| 666682 | 5214 | 5229 | 23331 | 23346 | TACCAACGACAGCATA | 39 | 653 |
| 666683 | 5221 | 5236 | 23338 | 23353 | TGATGTATACCAACGA | 13 | 654 |
| 666684 | 5246 | 5261 | 23363 | 23378 | GCAGAGCAATTTACAT | 34 | 655 |
| 666685 | 5253 | 5268 | 23370 | 23385 | TTGCTTTGCAGAGCAA | 72 | 656 |

TABLE 11

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 15 | 195 |
| 666688 | N/A | N/A | 18773 | 18788 | CTTAAGCTAAACTCCT | 73 | 657 |
| 666689 | N/A | N/A | 18780 | 18795 | ATGACGACTTAAGCTA | 38 | 658 |
| 666690 | N/A | N/A | 18803 | 18818 | ATATTAGAGACTGTAT | 75 | 659 |
| 666691 | N/A | N/A | 18817 | 18832 | CTCCATCAATCATGAT | 67 | 660 |
| 666692 | N/A | N/A | 18824 | 18839 | GAATGCTCTCCATCAA | 55 | 661 |
| 666693 | N/A | N/A | 18831 | 18846 | GCAAGCTGAATGCTCT | 47 | 662 |
| 666694 | N/A | N/A | 18838 | 18853 | ATCTAAGGCAAGCTGA | 63 | 663 |
| 666695 | N/A | N/A | 18845 | 18860 | TTACAGCATCTAAGGC | 79 | 664 |
| 666696 | N/A | N/A | 18866 | 18881 | AATGTTCAGCTTTTCC | 37 | 665 |
| 666697 | N/A | N/A | 18873 | 18888 | ACGCCTTAATGTTCAG | 23 | 666 |

TABLE 11-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666699 | N/A | N/A | 22817 | 22832 | GACTTCGGGAGATACG | 86 | 667 |
| 666700 | N/A | N/A | 22824 | 22839 | CACAGAGGACTTCGGG | 51 | 668 |
| 666701 | N/A | N/A | 3917 | 3932 | CCCTTCCCGCTCCGAA | 84 | 669 |
| 666702 | N/A | N/A | 4018 | 4033 | AGGCTCGGGCAGAGCC | 99 | 670 |
| 666703 | N/A | N/A | 4254 | 4269 | GAGCACCGCGCCGGAG | 93 | 671 |
| 666704 | N/A | N/A | 4288 | 4303 | ATGTGGAGCTCCTCCT | 80 | 672 |
| 666705 | N/A | N/A | 4546 | 4561 | GCCCCGAATAGGACCC | 79 | 673 |
| 666706 | N/A | N/A | 4593 | 4608 | CCGGGTTCCTCCACCC | 91 | 674 |
| 666707 | N/A | N/A | 4653 | 4668 | CCTGGCGGCCTCCACG | 131 | 675 |
| 666709 | N/A | N/A | 4856 | 4871 | AGGCTCCTACCCGCCT | 94 | 676 |
| 666710 | N/A | N/A | 4965 | 4980 | TGCCGTGTCAGGGTCG | 89 | 677 |
| 666711 | N/A | N/A | 4993 | 5008 | GAGTCTTTGAGGCTGC | 66 | 678 |
| 666712 | N/A | N/A | 5759 | 5774 | ACAGGCGCGGACGCAC | 80 | 679 |
| 666713 | N/A | N/A | 5867 | 5882 | CGAGAAGAGAGGCTGA | 93 | 680 |
| 666714 | N/A | N/A | 6304 | 6319 | GACACATTTTCTGGGT | 36 | 681 |
| 666715 | N/A | N/A | 7071 | 7086 | GATGCTCAGAATGAAG | 57 | 682 |
| 666716 | N/A | N/A | 7190 | 7205 | CTATGCTGAACCCCAC | 99 | 683 |
| 666717 | N/A | N/A | 7197 | 7212 | AATTCTCCTATGCTGA | 87 | 684 |
| 666718 | N/A | N/A | 7380 | 7395 | AGTGATGAGATATTCC | 41 | 685 |
| 666719 | N/A | N/A | 7519 | 7534 | TCCAGATGCAGATTCC | 54 | 686 |
| 666720 | N/A | N/A | 7536 | 7551 | TCACCTGAAGGATTTG | 75 | 687 |
| 666721 | N/A | N/A | 7731 | 7746 | ATGCATAACACGGTGT | 55 | 688 |
| 666722 | N/A | N/A | 7963 | 7978 | ACACAGCCTCGCCCTC | 80 | 689 |
| 666723 | N/A | N/A | 8094 | 8109 | AGCACCGTGTGGAAAG | 43 | 690 |
| 666724 | N/A | N/A | 8126 | 8141 | ACCCTCCCCAACTTAA | 90 | 691 |
| 666725 | N/A | N/A | 8336 | 8351 | CTGGCACCAAAAGTAC | 82 | 692 |
| 666726 | N/A | N/A | 8539<br>8747<br>8851<br>8903<br>9059 | 8554<br>8762<br>8866<br>8918<br>9074 | ACTGGCATTGAGACGG | 21 | 693 |
| 666727 | N/A | N/A | 8540<br>8748<br>8852<br>8904<br>9060 | 8555<br>8763<br>8867<br>8919<br>9075 | CACTGGCATTGAGACG | 24 | 694 |
| 666728 | N/A | N/A | 8541<br>8749<br>8853<br>8905<br>9061 | 8556<br>8764<br>8868<br>8920<br>9076 | GCACTGGCATTGAGAC | 27 | 695 |
| 666729 | N/A | N/A | 8543<br>8751 | 8558<br>8766 | AAGCACTGGCATTGAG | 58 | 696 |

TABLE 11-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
|  |  |  | 8855 | 8870 |  |  |  |
|  |  |  | 8907 | 8922 |  |  |  |
|  |  |  | 9063 | 9078 |  |  |  |
| 666730 | N/A | N/A | 8544 | 8559 | GAAGCACTGGCATTGA | 45 | 697 |
|  |  |  | 8752 | 8767 |  |  |  |
|  |  |  | 8856 | 8871 |  |  |  |
|  |  |  | 8908 | 8923 |  |  |  |
|  |  |  | 9064 | 9079 |  |  |  |
| 666731 | N/A | N/A | 8545 | 8560 | AGAAGCACTGGCATTG | 55 | 698 |
|  |  |  | 9065 | 9080 |  |  |  |
| 666732 | N/A | N/A | 8548 | 8563 | ATAAGAAGCACTGGCA | 49 | 699 |
|  |  |  | 8704 | 8719 |  |  |  |
|  |  |  | 8808 | 8823 |  |  |  |
|  |  |  | 8964 | 8979 |  |  |  |
|  |  |  | 9068 | 9083 |  |  |  |
| 666733 | N/A | N/A | 8549 | 8564 | GATAAGAAGCACTGGC | 37 | 700 |
|  |  |  | 8705 | 8720 |  |  |  |
|  |  |  | 8809 | 8824 |  |  |  |
|  |  |  | 8965 | 8980 |  |  |  |
|  |  |  | 9069 | 9084 |  |  |  |
| 666734 | N/A | N/A | 8551 | 8566 | GAGATAAGAAGCACTG | 56 | 701 |
|  |  |  | 8707 | 8722 |  |  |  |
|  |  |  | 8811 | 8826 |  |  |  |
|  |  |  | 8967 | 8982 |  |  |  |
|  |  |  | 9071 | 9086 |  |  |  |
| 666735 | N/A | N/A | 8553 | 8568 | CTGAGATAAGAAGCAC | 63 | 702 |
|  |  |  | 8709 | 8724 |  |  |  |
|  |  |  | 8813 | 8828 |  |  |  |
|  |  |  | 8969 | 8984 |  |  |  |
|  |  |  | 9073 | 9088 |  |  |  |
| 666737 | N/A | N/A | 8574 | 8589 | GGTAAAGGAGTGCAGG | 54 | 703 |
|  |  |  | 8626 | 8641 |  |  |  |
|  |  |  | 8678 | 8693 |  |  |  |
|  |  |  | 8730 | 8745 |  |  |  |
|  |  |  | 8834 | 8849 |  |  |  |
|  |  |  | 8886 | 8901 |  |  |  |
|  |  |  | 8938 | 8953 |  |  |  |
|  |  |  | 8990 | 9005 |  |  |  |
|  |  |  | 9042 | 9057 |  |  |  |
| 666738 | N/A | N/A | 8591 | 8606 | ACTGGCATCGAGACGG | 21 | 704 |
|  |  |  | 8643 | 8658 |  |  |  |
|  |  |  | 8695 | 8710 |  |  |  |
|  |  |  | 8799 | 8814 |  |  |  |
|  |  |  | 8955 | 8970 |  |  |  |
|  |  |  | 9007 | 9022 |  |  |  |
| 666739 | N/A | N/A | 8592 | 8607 | CACTGGCATCGAGACG | 39 | 705 |
|  |  |  | 8644 | 8659 |  |  |  |
|  |  |  | 8696 | 8711 |  |  |  |
|  |  |  | 8800 | 8815 |  |  |  |
|  |  |  | 8956 | 8971 |  |  |  |
|  |  |  | 9008 | 9023 |  |  |  |
| 666740 | N/A | N/A | 8594 | 8609 | AGCACTGGCATCGAGA | 41 | 706 |
|  |  |  | 8646 | 8661 |  |  |  |
|  |  |  | 8698 | 8713 |  |  |  |
|  |  |  | 8802 | 8817 |  |  |  |
|  |  |  | 8958 | 8973 |  |  |  |
|  |  |  | 9010 | 9025 |  |  |  |
| 666741 | N/A | N/A | 8595 | 8610 | AAGCACTGGCATCGAG | 73 | 707 |
|  |  |  | 8647 | 8662 |  |  |  |
|  |  |  | 8699 | 8714 |  |  |  |
|  |  |  | 8803 | 8818 |  |  |  |

TABLE 11-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| | | | 8959 | 8974 | | | |
| | | | 9011 | 9026 | | | |
| 666742 | N/A | N/A | 8597 | 8612 | GGAAGCACTGGCATCG | 45 | 708 |
| | | | 8649 | 8664 | | | |
| | | | 9013 | 9028 | | | |
| 666743 | N/A | N/A | 8600 | 8615 | ATAGGAAGCACTGGCA | 58 | 709 |
| | | | 8652 | 8667 | | | |
| | | | 8756 | 8771 | | | |
| | | | 8860 | 8875 | | | |
| | | | 8912 | 8927 | | | |
| | | | 9016 | 9031 | | | |
| 666744 | N/A | N/A | 8601 | 8616 | GATAGGAAGCACTGGC | 38 | 710 |
| | | | 8653 | 8668 | | | |
| | | | 8757 | 8772 | | | |
| | | | 8861 | 8876 | | | |
| | | | 8913 | 8928 | | | |
| | | | 9017 | 9032 | | | |
| 666745 | N/A | N/A | 8602 | 8617 | AGATAGGAAGCACTGG | 54 | 711 |
| | | | 8654 | 8669 | | | |
| | | | 8758 | 8773 | | | |
| | | | 8862 | 8877 | | | |
| | | | 8914 | 8929 | | | |
| | | | 9018 | 9033 | | | |
| 666746 | N/A | N/A | 8603 | 8618 | GAGATAGGAAGCACTG | 52 | 712 |
| | | | 8655 | 8670 | | | |
| | | | 8759 | 8774 | | | |
| | | | 8863 | 8878 | | | |
| | | | 8915 | 8930 | | | |
| | | | 9019 | 9034 | | | |
| 666747 | N/A | N/A | 8604 | 8619 | TGAGATAGGAAGCACT | 62 | 713 |
| | | | 8656 | 8671 | | | |
| | | | 8760 | 8775 | | | |
| | | | 8864 | 8879 | | | |
| | | | 8916 | 8931 | | | |
| | | | 9020 | 9035 | | | |
| 666748 | N/A | N/A | 8605 | 8620 | CTGAGATAGGAAGCAC | 74 | 714 |
| | | | 8657 | 8672 | | | |
| | | | 8761 | 8776 | | | |
| | | | 8865 | 8880 | | | |
| | | | 8917 | 8932 | | | |
| | | | 9021 | 9036 | | | |
| 666749 | N/A | N/A | 9410 | 9425 | GGATGCCACCATCCCA | 105 | 715 |
| 666750 | N/A | N/A | 9490 | 9505 | GGAGTGATCTCTGTGG | 32 | 716 |
| 666751 | N/A | N/A | 9708 | 9723 | GTAGGTAGGCACCTGT | 25 | 717 |
| 666752 | N/A | N/A | 9796 | 9811 | GAGGGAGCTCATTTTG | 76 | 718 |
| 666753 | N/A | N/A | 9960 | 9975 | AAAGGCCAAATTGCAA | 48 | 719 |
| 666754 | N/A | N/A | 9997 | 10012 | CTGCAGCCAAGGATAA | 52 | 720 |
| 666818 | N/A | N/A | 3925 | 3940 | GGCGCGCTCCCTTCCC | 90 | 721 |
| 666819 | N/A | N/A | 4685 | 4700 | CCCTTCCCCGCGACTC | 81 | 722 |
| 666820 | N/A | N/A | 4717 | 4732 | TTGCCTTCGCTCACTC | 78 | 723 |
| 666821 | N/A | N/A | 5757 | 5772 | AGGCGCGGACGCACGG | 69 | 724 |
| 666822 | N/A | N/A | 6997 | 7012 | CTACCTTTTTGGCTCC | 83 | 725 |
| 666823 | N/A | N/A | 7585 | 7600 | TGCCTTGTGACATAAA | 55 | 726 |

TABLE 11-continued

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666824 | N/A | N/A | 8151 | 8166 | ATATTCCAACAGGCGG | 47 | 727 |
| 666825 | N/A | N/A | 8437 | 8452 | TGAACCCTTCATCAGA | 52 | 728 |
| 666826 | N/A | N/A | 9313 | 9328 | AGACCAGGATTCGCCA | 67 | 729 |

TABLE 12

Percent control of human IRF4 mRNA with 3-10-3 cEt gapmers
with phosphorothioate internucleotide linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 23 | 195 |
| 666755 | N/A | N/A | 10003 | 10018 | CACTACCTGCAGCCAA | 69 | 730 |
| 666756 | N/A | N/A | 10020 | 10035 | AGAGTGGTACACCTCT | 78 | 731 |
| 666757 | N/A | N/A | 10256 | 10271 | GTCTCTACCTACTCCA | 59 | 732 |
| 666758 | N/A | N/A | 10308 | 10323 | AACACCTGATCTTGCT | 110 | 733 |
| 666759 | N/A | N/A | 10366 | 10381 | ACCATGTTCCTGAAGA | 56 | 734 |
| 666760 | N/A | N/A | 10660 | 10675 | CTCTTGTGAGGCAAAG | 52 | 735 |
| 666761 | N/A | N/A | 10712 | 10727 | GCGCCCAATCACCTTC | 97 | 736 |
| 666762 | N/A | N/A | 11002 | 11017 | ATCGAATCTGCCCAAA | 74 | 737 |
| 666763 | N/A | N/A | 11010 | 11025 | AAAGTCCCATCGAATC | 87 | 738 |
| 666764 | N/A | N/A | 11024 | 11039 | CAAAGCAAGTGTCTAA | 77 | 739 |
| 666765 | N/A | N/A | 11070 | 11085 | CTCACACACAGGATGT | 82 | 740 |
| 666767 | N/A | N/A | 11344 | 11359 | GAGGAGGAGGACTTAT | 49 | 741 |
| 666768 | N/A | N/A | 11408 | 11423 | TATTACTCTTAGGCAC | 56 | 742 |
| 666769 | N/A | N/A | 11545 | 11560 | GTGCCTTCTTTATAGT | 51 | 743 |
| 666770 | N/A | N/A | 11551 | 11566 | CTAGAGGTGCCTTCTT | 74 | 744 |
| 666771 | N/A | N/A | 11682 | 11697 | TGCCAGAGGGCAAGAT | 98 | 745 |
| 666772 | N/A | N/A | 11975 | 11990 | GCTGTTTATTTCCTAC | 34 | 746 |
| 666773 | N/A | N/A | 11988 | 12003 | CGAGATATAAATAGCT | 42 | 747 |
| 666774 | N/A | N/A | 11990 | 12005 | GCCGAGATATAAATAG | 60 | 748 |
| 666775 | N/A | N/A | 12032 | 12047 | GCAGGTTTCATTTCAT | 56 | 749 |
| 666776 | N/A | N/A | 12034 | 12049 | GGGCAGGTTTCATTTC | 68 | 750 |
| 666777 | N/A | N/A | 12067 | 12082 | AGAGTGGGTGTTGGCC | 75 | 751 |
| 666779 | N/A | N/A | 12274 | 12289 | ATGGAACCCCAAAATC | 76 | 752 |
| 666780 | N/A | N/A | 12292 | 12307 | GCTGCCACTGGTAACT | 74 | 753 |
| 666781 | N/A | N/A | 12374 | 12389 | TCGCCCATGAGTTGAA | 61 | 754 |
| 666782 | N/A | N/A | 12516 | 12531 | AGTTCATGTAAAGTCT | 39 | 755 |
| 666783 | N/A | N/A | 12865 | 12880 | TCGGTCCACATACCTG | 61 | 756 |

TABLE 12-continued

Percent control of human IRF4 mRNA with 3-10-3 cEt gapmers
with phosphorothioate internucleotide linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666784 | N/A | N/A | 13199 | 13214 | CTTGGAGAAGTCCCGT | 61 | 757 |
| 666785 | N/A | N/A | 13330 | 13345 | CCTGTGGTGGAACTCT | 73 | 758 |
| 666786 | N/A | N/A | 14020 | 14035 | AAGAGGCGACTGCTGA | 65 | 759 |
| 666787 | N/A | N/A | 14028 | 14043 | ACTGTTTTAAGAGGCG | 30 | 760 |
| 666788 | N/A | N/A | 14046 | 14061 | ATAGTGCAATGAAATG | 64 | 761 |
| 666789 | N/A | N/A | 14094 | 14109 | GGGAACCTGAAAAGAG | 79 | 762 |
| 666790 | N/A | N/A | 14338 | 14353 | GAGGTTCGCTGAATTG | 70 | 763 |
| 666791 | N/A | N/A | 14687 | 14702 | ATCTGGATGAGCTTAC | 62 | 764 |
| 666792 | N/A | N/A | 14732 | 14747 | AGCTTAGTTATCTGGG | 41 | 765 |
| 666793 | N/A | N/A | 15213 | 15228 | GAACACCATGCCCAAC | 93 | 766 |
| 666794 | N/A | N/A | 15304 | 15319 | GAGCTCTTCCAGATCC | 95 | 767 |
| 666795 | N/A | N/A | 15596 | 15611 | TAGTCGCGCAAGTCTA | 108 | 768 |
| 666796 | N/A | N/A | 15777 | 15792 | ATCCTTAATTATGCAG | 61 | 769 |
| 666797 | N/A | N/A | 15790 | 15805 | GTGTTTGGTGGGAATC | 54 | 770 |
| 666798 | N/A | N/A | 15985 | 16000 | CTAACTTACAGGACTA | 69 | 771 |
| 666799 | N/A | N/A | 16059 | 16074 | TAGTGCTGTGCAGACC | 68 | 772 |
| 666800 | N/A | N/A | 16069 | 16084 | GGGCTGTCCCTAGTGC | 109 | 773 |
| 666801 | N/A | N/A | 16171 | 16186 | AATGTCACGCCCGCAA | 81 | 774 |
| 666802 | N/A | N/A | 16340 | 16355 | GGCCTCCCGCTTGTGG | 118 | 775 |
| 666803 | N/A | N/A | 16383 | 16398 | GAACAGTAACTTGACT | 96 | 776 |
| 666804 | N/A | N/A | 16419 | 16434 | AACTCTGAGTAGACTT | 72 | 777 |
| 666805 | N/A | N/A | 16471 | 16486 | GAGCACCAGCCATCGG | 77 | 778 |
| 666806 | N/A | N/A | 16649 | 16664 | GACCAATTTATGCCAT | 62 | 779 |
| 666807 | N/A | N/A | 16664 | 16679 | CACGCAATGGCAAAAG | 81 | 780 |
| 666808 | N/A | N/A | 16824 | 16839 | TCCTTTGGGTGCTTTC | 68 | 781 |
| 666809 | N/A | N/A | 16888 | 16903 | CTCTTACTCCGCTGAG | 105 | 782 |
| 666810 | N/A | N/A | 16953 | 16968 | ACACACCAGGTTAAAC | 88 | 783 |
| 666811 | N/A | N/A | 17135 | 17150 | AGTGTAACTGAGGACT | 107 | 784 |
| 666812 | N/A | N/A | 17740 | 17755 | TGTTACTTGCCACAGT | 61 | 785 |
| 666813 | N/A | N/A | 17916 | 17931 | ATGCAAGCCCGTTAAT | 96 | 786 |
| 666814 | N/A | N/A | 17966 | 17981 | ATGAGAACTTTGATGT | 85 | 787 |
| 666815 | N/A | N/A | 18136 | 18151 | AAGTCAATCACTGGAG | 39 | 788 |
| 666816 | N/A | N/A | 18196 | 18211 | TTAGCAATTCCTGTTG | 80 | 789 |
| 666817 | N/A | N/A | 18938 | 18953 | GCTAACTGGCCTCAAA | 91 | 790 |
| 666827 | N/A | N/A | 10288 | 10303 | CTTCATTTACTGTTAC | 69 | 791 |
| 666828 | N/A | N/A | 10484 | 10499 | CAACAGAGCTGAGAGT | 80 | 792 |
| 666829 | N/A | N/A | 11844 | 11859 | CTCACGAGCACCTCAG | 58 | 793 |

TABLE 12-continued

Percent control of human IRF4 mRNA with 3-10-3 cEt gapmers with phosphorothioate internucleotide linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 666830 | N/A | N/A | 13244 | 13259 | CTTGTCTCCCCCAGAG | 97 | 794 |
| 666831 | N/A | N/A | 13798 | 13813 | CCACCTCCATTCTAAC | 115 | 795 |
| 666832 | N/A | N/A | 14081 | 14096 | GAGCCGCCACATCAGC | 77 | 796 |
| 666833 | N/A | N/A | 14193 | 14208 | CCACCCTCCGTCTCAC | 67 | 797 |
| 666834 | N/A | N/A | 14242 | 14257 | TATAGCACTCTCCTAT | 98 | 798 |
| 666836 | N/A | N/A | 16203 | 16218 | CAAGACAAATCTTCTG | 87 | 799 |
| 666837 | N/A | N/A | 16641 | 16656 | TATGCCATGGACAAGT | 81 | 800 |
| 666838 | N/A | N/A | 16948 | 16963 | CCAGGTTAAACAGGAA | 94 | 801 |
| 666839 | N/A | N/A | 19232 | 19247 | GACTTAATTCTGGGTT | 65 | 802 |
| 666840 | N/A | N/A | 19412 | 19427 | ACTGAGATATCCTGCA | 81 | 803 |

Example 5: Effect of 3-10-3 cEt Gapmers with Phosphorothioate Internucleoside Linkages on Human IRF4 In Vitro, Single Dose Modified oligonucleotides complementary to a human IRF4 nucleic acid were designed and tested for their effect on IRF4 mRNA in vitro.

Cultured SK-MEL-28 cells at a density of 20,000 cells per well were transfected using electroporation with 4,000 nM concentration of modified oligonucleotide or no modified oligonucleotide for untreated controls. After approximately 24 hours, RNA was isolated from the cells and IRF4 mRNA levels were measured by quantitative real-time PCR. Human primer probe set RTS3114 (described hereinabove in Example 1) was used to measure mRNA levels. IRF4 mRNA levels were adjusted according to total RNA content, as measured by RIBOGREEN®. Results are presented in the table below as percent control of the amount of IRF4 mRNA, relative to untreated control (UTC) cells.

The modified oligonucleotides in Tables 13 through 24 are 3-10-3 cEt gapmers. The gapmers are 16 nucleobases in length, wherein the central gap segment comprises ten 2'-deoxynucleosides and is flanked by wing segments on both the 5' end and on the 3' end comprising three cEt nucleosides. The sugar motif for the gapmers is (from 5' to 3'): kkkddddddddddkkk; wherein 'd' represents a 2'-deoxyribose sugar and 'k' represents a cEt modified sugar. Each internucleoside linkage is a phosphorothioate internucleoside linkage and each cytosine residue is a 5-methylcytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Tables 13 through 24 below is complementary to human IRF4 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to human IRF4 reduced the amount of human IRF4 mRNA.

TABLE 13

Percent control of human IRF4 mRNA with 3-10-3 cEt gapmers with phosphorothioate internucleotide linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 24 | 195 |
| 881075 | 2 | 17 | 3741 | 3756 | AACTGAGAGTGCGAGG | 99 | 804 |
| 881099 | 342 | 357 | 6821 | 6836 | AAACAGTGCCCAAGCC | 75 | 805 |
| 881122 | 624 | 639 | 9114 | 9129 | CATCATGTAGTTGTGA | 59 | 806 |
| 881169 | 1192 | 1207 | 13745 | 13760 | TGTCAAAGAGCTTGCA | 89 | 807 |
| 881193 | 1416 | 1431 | 19533 | 19548 | GCTGATGTGTTCTGGT | 21 | 808 |
| 881217 | 1740 | 1755 | 19857 | 19872 | CAGTAAGAGGGCAGTC | 50 | 809 |
| 881241 | 1927 | 1942 | 20044 | 20059 | CATCACTTGGTCAATT | 71 | 810 |
| 881265 | 2042 | 2057 | 20159 | 20174 | CCTACAAGCAGTCATC | 46 | 811 |

TABLE 13-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881289 | 2194 | 2209 | 20311 | 20326 | CTACAGGCACGGCTTC | 48 | 812 |
| 881313 | 2385 | 2400 | 20502 | 20517 | TACTAGATTGTAGGAC | 73 | 813 |
| 881337 | 2512 | 2527 | 20629 | 20644 | CAACAGTTCAAGTATT | 65 | 814 |
| 881361 | 2665 | 2680 | 20782 | 20797 | TTCCAGTGGTGGGTCC | 71 | 815 |
| 881385 | 2826 | 2841 | 20943 | 20958 | CAAGTGGAGGTCTTTG | 33 | 816 |
| 881409 | 2911 | 2926 | 21028 | 21043 | ATGAGAAACGGCCTGG | 36 | 817 |
| 881433 | 3047 | 3062 | 21164 | 21179 | AATGTAGGGATACAGC | 38 | 818 |
| 881457 | 3273 | 3288 | 21390 | 21405 | AATAAACACCCCTTCT | 79 | 819 |
| 881481 | 3419 | 3434 | 21536 | 21551 | CTCCACAGCAAGGCCT | 49 | 820 |
| 881505 | 3507 | 3522 | 21624 | 21639 | GTTCACGAAACACAGT | 37 | 821 |
| 881528 | 3625 | 3640 | 21742 | 21757 | CAAAGAGGGTCACAGG | 37 | 822 |
| 881552 | 3903 | 3918 | 22020 | 22035 | CCCTAGGTCATACCCT | 43 | 823 |
| 881576 | 4052 | 4067 | 22169 | 22184 | CTTCAACAGCACTGTC | 44 | 824 |
| 881595 | 4285 | 4300 | 22402 | 22417 | CTGTAGGGCGACTAAC | 51 | 825 |
| 881619 | 4412 | 4427 | 22529 | 22544 | CTAATACCTACCTGCC | 53 | 826 |
| 881643 | 4545 | 4560 | 22662 | 22677 | GCACACACAAGTGGCC | 36 | 827 |
| 881667 | 4602 | 4617 | 22719 | 22734 | AGCAATGAACGGAAGT | 20 | 828 |
| 881691 | 4839 | 4854 | 22956 | 22971 | GGCTATCAGGATCTCA | 55 | 829 |
| 881715 | 5030 | 5045 | 23147 | 23162 | CCCCATTGCCTGTTAA | 80 | 830 |
| 881739 | 5206 | 5221 | 23323 | 23338 | ACAGCATAGCATTATC | 36 | 831 |
| 881763 | N/A | N/A | 18778 | 18793 | GACGACTTAAGCTAAA | 38 | 832 |
| 881787 | N/A | N/A | 18847 | 18862 | ATTTACAGCATCTAAG | 53 | 833 |
| 881809 | N/A | N/A | 4075 | 4090 | GCTCATCCCGTCCAGC | 85 | 834 |
| 881832 | N/A | N/A | 4402 | 4417 | GGAGAGCGGAGGCGGG | 79 | 835 |
| 881855 | N/A | N/A | 4644 | 4659 | CTCCACGCGCGGAGGA | 101 | 836 |
| 881879 | N/A | N/A | 5038 | 5053 | GGGCACCCCGCCCCGA | 99 | 837 |
| 881903 | N/A | N/A | 5660 | 5675 | GCACGGACGAACGCGC | 77 | 838 |
| 881925 | N/A | N/A | 5777 | 5792 | ACGAAAACAGCCGCCG | 86 | 839 |
| 881947 | N/A | N/A | 6136 | 6151 | GAGCAAATTGAGACCA | 45 | 840 |
| 881971 | N/A | N/A | 6415 | 6430 | GCGCATAGGTCCTTCA | 37 | 841 |
| 881993 | N/A | N/A | 7155 | 7170 | CCACATAACTCAGGCA | 30 | 842 |
| 882017 | N/A | N/A | 7376 | 7391 | ATGAGATATTCCTCTC | 68 | 843 |
| 882041 | N/A | N/A | 7696 | 7711 | CAGCAACTCCCTTGGG | 77 | 844 |
| 882065 | N/A | N/A | 8145 | 8160 | CAACAGGCGGACACGC | 58 | 845 |
| 882088 | N/A | N/A | 8385 | 8400 | ATGGAGATACTTGTAC | 38 | 846 |
| 882112 | N/A | N/A | 8554 8710 8814 | 8569 8725 8829 | GCTGAGATAAGAAGCA | 68 | 847 |

TABLE 13-continued

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| | | | 8970 | 8985 | | | |
| | | | 9074 | 9089 | | | |
| 882135 | N/A | N/A | 9362 | 9377 | GCACACGCAGCCTCTA | 95 | 848 |
| 882158 | N/A | N/A | 9606 | 9621 | CCACTATTCGAGAGAA | 43 | 849 |
| 882182 | N/A | N/A | 9981 | 9996 | CCTGAACATGACTGGG | 62 | 850 |
| 882205 | N/A | N/A | 10162 | 10177 | GAATTTCAGGAGCTAG | 39 | 851 |
| 882229 | N/A | N/A | 10314 | 10329 | GCACAGAACACCTGAT | 44 | 852 |
| 882253 | N/A | N/A | 10616 | 10631 | AGCTGATGGAGAAACG | 90 | 853 |
| 882277 | N/A | N/A | 11088 | 11103 | CTAAATCACCCTGGTC | 53 | 854 |
| 882301 | N/A | N/A | 11366 | 11381 | GAACTAATGTCCCCAG | 39 | 855 |
| 882325 | N/A | N/A | 11666 | 11681 | GAGAATTCCAAACCTT | 24 | 856 |
| 882349 | N/A | N/A | 11940 | 11955 | GTCTTAGGTGTTCAAG | 44 | 857 |
| 882373 | N/A | N/A | 12157 | 12172 | CAGCAGGTTTTGAGAC | 80 | 858 |
| 882397 | N/A | N/A | 12512 | 12527 | CATGTAAAGTCTGCTG | 42 | 859 |
| 882420 | N/A | N/A | 12893 | 12908 | ATATAACGGTGTTTCA | 42 | 860 |
| 882443 | N/A | N/A | 13175 | 13190 | ACCCATTTAATCTGTC | 43 | 861 |
| 882465 | N/A | N/A | 13791 | 13806 | CATTCTAACAGATAAC | 102 | 862 |
| 882487 | N/A | N/A | 14150 | 14165 | ACACACCTGACAACCA | 64 | 863 |
| 882510 | N/A | N/A | 14374 | 14389 | GCATGACAGGGCGAGG | 57 | 864 |
| 882533 | N/A | N/A | 14708 | 14723 | TGCTTTGGGCACCAAA | 48 | 865 |
| 882557 | N/A | N/A | 15460 | 15475 | GCCCAGCAAGAGGCAC | 93 | 866 |
| 882580 | N/A | N/A | 15804 | 15819 | TAGATAACATGAGAGT | 50 | 867 |
| 882603 | N/A | N/A | 15925 | 15940 | CAAATGACTTAGTCAG | 45 | 868 |
| 882627 | N/A | N/A | 16168 | 16183 | GTCACGCCCGCAAAAG | 61 | 869 |
| 882650 | N/A | N/A | 16388 | 16403 | GGATGGAACAGTAACT | 48 | 870 |
| 882674 | N/A | N/A | 16667 | 16682 | AGTCACGCAATGGCAA | 50 | 871 |
| 882698 | N/A | N/A | 16900 | 16915 | GAGGAATGAGCACTCT | 74 | 872 |
| 882722 | N/A | N/A | 17238 | 17253 | GGTTACGCTTATTTTT | 36 | 873 |
| 882746 | N/A | N/A | 17493 | 17508 | GCTAGATAGCATTCTT | 44 | 874 |
| 882770 | N/A | N/A | 17733 | 17748 | TGCCACAGTTGAACCC | 50 | 875 |
| 882794 | N/A | N/A | 17987 | 18002 | TAGCATCAGAGCTAGA | 51 | 876 |
| 882817 | N/A | N/A | 18582 | 18597 | CTGGATTGATGTGATA | 57 | 877 |
| 882841 | N/A | N/A | 18961 | 18976 | ACTACTATTGTGGAAA | 82 | 878 |
| 882864 | N/A | N/A | 19234 | 19249 | GTGACTTAATTCTGGG | 49 | 879 |

TABLE 14

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 14 | 195 |
| 881076 | 6 | 21 | 3745 | 3760 | GTGAAACTGAGAGTGC | 120 | 880 |
| 881100 | 343 | 358 | 6822 | 6837 | TAAACAGTGCCCAAGC | 59 | 881 |
| 881123 | 682 | 697 | 9172 | 9187 | GGATTTCCGGGTGTGG | 39 | 882 |
| 881170 | 1206 | 1221 | 13759 | 13774 | CAAGAACTGCTGTGTG | 105 | 883 |
| 881194 | 1432 | 1447 | 19549 | 19564 | GGTAATCTTCTGGATT | 70 | 884 |
| 881218 | 1741 | 1756 | 19858 | 19873 | ACAGTAAGAGGGCAGT | 16 | 885 |
| 881242 | 1930 | 1945 | 20047 | 20062 | ACACATCACTTGGTCA | 22 | 886 |
| 881266 | 2043 | 2058 | 20160 | 20175 | ACCTACAAGCAGTCAT | 54 | 887 |
| 881290 | 2195 | 2210 | 20312 | 20327 | GCTACAGGCACGGCTT | 16 | 888 |
| 881314 | 2387 | 2402 | 20504 | 20519 | ATTACTAGATTGTAGG | 50 | 889 |
| 881338 | 2515 | 2530 | 20632 | 20647 | GGGCAACAGTTCAAGT | 64 | 890 |
| 881362 | 2686 | 2701 | 20803 | 20818 | CCGTAGTCAGCTCCAT | 27 | 891 |
| 881386 | 2828 | 2843 | 20945 | 20960 | AGCAAGTGGAGGTCTT | 37 | 892 |
| 881410 | 2912 | 2927 | 21029 | 21044 | TATGAGAAACGGCCTG | 55 | 893 |
| 881434 | 3048 | 3063 | 21165 | 21180 | TAATGTAGGGATACAG | 22 | 894 |
| 881458 | 3275 | 3290 | 21392 | 21407 | AGAATAAACACCCCTT | 26 | 895 |
| 881482 | 3429 | 3444 | 21546 | 21561 | GGCAGTGGAGCTCCAC | 27 | 896 |
| 881506 | 3510 | 3525 | 21627 | 21642 | GCAGTTCACGAAACAC | 20 | 897 |
| 881529 | 3628 | 3643 | 21745 | 21760 | CAGCAAAGAGGGTCAC | 39 | 898 |
| 881553 | 3904 | 3919 | 22021 | 22036 | TCCCTAGGTCATACCC | 42 | 899 |
| 881577 | 4058 | 4073 | 22175 | 22190 | TCAAATCTTCAACAGC | 24 | 900 |
| 881596 | 4300 | 4315 | 22417 | 22432 | GTCTAGCTGGGTTTTC | 37 | 901 |
| 881620 | 4413 | 4428 | 22530 | 22545 | ACTAATACCTACCTGC | 52 | 902 |
| 881644 | 4547 | 4562 | 22664 | 22679 | ACGCACACACAAGTGG | 41 | 903 |
| 881668 | 4608 | 4623 | 22725 | 22740 | CTGGAGAGCAATGAAC | 33 | 904 |
| 881692 | 4844 | 4859 | 22961 | 22976 | TAACAGGCTATCAGGA | 74 | 905 |
| 881716 | 5040 | 5055 | 23157 | 23172 | GGGAAGTGGACCCCAT | 91 | 906 |
| 881740 | 5208 | 5223 | 23325 | 23340 | CGACAGCATAGCATTA | 25 | 907 |
| 881764 | N/A | N/A | 18782 | 18797 | ATATGACGACTTAAGC | 62 | 908 |
| 881788 | N/A | N/A | 18849 | 18864 | GAATTTACAGCATCTA | 24 | 909 |
| 881810 | N/A | N/A | 4084 | 4099 | GTCCGGTTAGCTCATC | 55 | 910 |
| 881833 | N/A | N/A | 4403 | 4418 | GGGAGAGCGGAGGCGG | 78 | 911 |
| 881856 | N/A | N/A | 4703 | 4718 | TCCCAACCCGCTTCTC | 86 | 912 |
| 881880 | N/A | N/A | 5056 | 5071 | CACGAGGCACCGCACT | 113 | 913 |
| 881904 | N/A | N/A | 5664 | 5679 | GAACGCACGGACGAAC | 82 | 914 |
| 881926 | N/A | N/A | 5778 | 5793 | GACGAAAACAGCCGCC | 38 | 915 |

TABLE 14-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881948 | N/A | N/A | 6141 | 6156 | TCTGAGAGCAAATTGA | 71 | 916 |
| 881994 | N/A | N/A | 7157 | 7172 | ACCCACATAACTCAGG | 69 | 917 |
| 882018 | N/A | N/A | 7384 | 7399 | GCATAGTGATGAGATA | 41 | 918 |
| 882042 | N/A | N/A | 7717 | 7732 | GTTGACAAATAAGGTA | 40 | 919 |
| 882066 | N/A | N/A | 8146 | 8161 | CCAACAGGCGGACACG | 17 | 920 |
| 882089 | N/A | N/A | 8391 | 8406 | AGGACAATGGAGATAC | 28 | 921 |
| 882113 | N/A | N/A | 8566 | 8581 | AGTGCAGGAGAGGCTG | 64 | 922 |
|  |  |  | 8618 | 8633 |  |  |  |
|  |  |  | 8670 | 8685 |  |  |  |
|  |  |  | 8722 | 8737 |  |  |  |
|  |  |  | 8774 | 8789 |  |  |  |
|  |  |  | 8826 | 8841 |  |  |  |
|  |  |  | 8878 | 8893 |  |  |  |
|  |  |  | 8930 | 8945 |  |  |  |
|  |  |  | 8982 | 8997 |  |  |  |
|  |  |  | 9034 | 9049 |  |  |  |
|  |  |  | 9086 | 9101 |  |  |  |
| 882136 | N/A | N/A | 9386 | 9401 | AGAAAACCCCCTCTC | 77 | 923 |
| 882159 | N/A | N/A | 9608 | 9623 | CACCACTATTCGAGAG | 52 | 924 |
| 882183 | N/A | N/A | 9986 | 10001 | GATAACCTGAACATGA | 83 | 925 |
| 882206 | N/A | N/A | 10172 | 10187 | ACGCAAGTCTGAATTT | 35 | 926 |
| 882230 | N/A | N/A | 10352 | 10367 | GACAATGTTGTATGAA | 28 | 927 |
| 882254 | N/A | N/A | 10634 | 10649 | GACCAACTGGAAAACC | 44 | 928 |
| 882278 | N/A | N/A | 11089 | 11104 | CCTAAATCACCCTGGT | 73 | 929 |
| 882302 | N/A | N/A | 11368 | 11383 | CAGAACTAATGTCCCC | 31 | 930 |
| 882326 | N/A | N/A | 11669 | 11684 | GATGAGAATTCCAAAC | 16 | 931 |
| 882350 | N/A | N/A | 11950 | 11965 | ACCCACACAAGTCTTA | 104 | 932 |
| 882374 | N/A | N/A | 12161 | 12176 | TCAACAGCAGGTTTTG | 59 | 933 |
| 882398 | N/A | N/A | 12515 | 12530 | GTTCATGTAAAGTCTG | 14 | 934 |
| 882421 | N/A | N/A | 12896 | 12911 | AAAATATAACGGTGTT | 69 | 935 |
| 882444 | N/A | N/A | 13196 | 13211 | GGAGAAGTCCCGTGGA | 41 | 936 |
| 882466 | N/A | N/A | 13881 | 13896 | CGCCGAAGTCAACAGG | 56 | 937 |
| 882488 | N/A | N/A | 14160 | 14175 | CATGAGGGTGACACAC | 53 | 938 |
| 882511 | N/A | N/A | 14376 | 14391 | CAGCATGACAGGGCGA | 44 | 939 |
| 882534 | N/A | N/A | 14716 | 14731 | GACATATTTGCTTTGG | 42 | 940 |
| 882558 | N/A | N/A | 15497 | 15512 | AGCTTAGTCACCACGG | 33 | 941 |
| 882581 | N/A | N/A | 15805 | 15820 | CTAGATAACATGAGAG | 47 | 942 |
| 882604 | N/A | N/A | 15926 | 15941 | CCAAATGACTTAGTCA | 49 | 943 |
| 882628 | N/A | N/A | 16177 | 16192 | CAATAAAATGTCACGC | 53 | 944 |
| 882651 | N/A | N/A | 16390 | 16405 | AGGGATGGAACAGTAA | 53 | 945 |
| 882675 | N/A | N/A | 16691 | 16706 | CGGGAGATAAAGAACA | 69 | 946 |
| 882699 | N/A | N/A | 16905 | 16920 | TGCAAGAGGAATGAGC | 16 | 947 |

TABLE 14-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882723 | N/A | N/A | 17239 | 17254 | GGGTTACGCTTATTTT | 35 | 948 |
| 882747 | N/A | N/A | 17508 | 17523 | AATGAAGATCCACTAG | 39 | 949 |
| 882771 | N/A | N/A | 17746 | 17761 | TTTTAGTGTTACTTGC | 68 | 950 |
| 882795 | N/A | N/A | 17990 | 18005 | AAATAGCATCAGAGCT | 87 | 951 |
| 882818 | N/A | N/A | 18584 | 18599 | AACTGGATTGATGTGA | 23 | 952 |
| 882842 | N/A | N/A | 18964 | 18979 | AAAACTACTATTGTGG | 86 | 953 |
| 882865 | N/A | N/A | 19240 | 19255 | GCCAAAGTGACTTAAT | 30 | 954 |
| 882898 | N/A | N/A | 6422 | 6437 | AAGAATGGCGCATAGG | 19 | 955 |

TABLE 15

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 45 | 195 |
| 881077 | 7 | 22 | 3746 | 3761 | GGTGAAACTGAGAGTG | 92 | 956 |
| 881101 | 344 | 359 | 6823 | 6838 | TTAAACAGTGCCCAAG | 79 | 957 |
| 881124 | 689 | 704 | 9179 | 9194 | TGGTACGGGATTTCCG | 63 | 958 |
| 881171 | 1207 | 1222 | 13760 | 13775 | ACAAGAACTGCTGTGT | 93 | 959 |
| 881195 | 1433 | 1448 | 19550 | 19565 | TGGTAATCTTCTGGAT | 76 | 960 |
| 881219 | 1744 | 1759 | 19861 | 19876 | AAAACAGTAAGAGGGC | 61 | 961 |
| 881243 | 1934 | 1949 | 20051 | 20066 | GTAAACACATCACTTG | 49 | 962 |
| 881267 | 2044 | 2059 | 20161 | 20176 | TACCTACAAGCAGTCA | 44 | 963 |
| 881291 | 2196 | 2211 | 20313 | 20328 | GGCTACAGGCACGGCT | 58 | 964 |
| 881315 | 2388 | 2403 | 20505 | 20520 | CATTACTAGATTGTAG | 91 | 965 |
| 881339 | 2520 | 2535 | 20637 | 20652 | CAGAAGGGCAACAGTT | 62 | 966 |
| 881363 | 2701 | 2716 | 20818 | 20833 | ACTGAGTGTGCAGTTC | 64 | 967 |
| 881387 | 2829 | 2844 | 20946 | 20961 | AAGCAAGTGGAGGTCT | 49 | 968 |
| 881411 | 2913 | 2928 | 21030 | 21045 | GTATGAGAAACGGCCT | 41 | 969 |
| 881435 | 3049 | 3064 | 21166 | 21181 | GTAATGTAGGGATACA | 52 | 970 |
| 881459 | 3277 | 3292 | 21394 | 21409 | GAAGAATAAACACCCC | 48 | 971 |
| 881483 | 3430 | 3445 | 21547 | 21562 | TGGCAGTGGAGCTCCA | 54 | 972 |
| 881507 | 3517 | 3532 | 21634 | 21649 | CATCACTGCAGTTCAC | 53 | 973 |
| 881530 | 3631 | 3646 | 21748 | 21763 | CTTCAGCAAAGAGGGT | 41 | 974 |
| 881554 | 3918 | 3933 | 22035 | 22050 | CATAGCTAGTTCATTC | 65 | 975 |
| 881578 | 4089 | 4104 | 22206 | 22221 | TCCATATGACCCAGTG | 34 | 976 |
| 881597 | 4305 | 4320 | 22422 | 22437 | CAATAGTCTAGCTGGG | 37 | 977 |
| 881621 | 4418 | 4433 | 22535 | 22550 | CAAACACTAATACCTA | 69 | 978 |

TABLE 15-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881645 | 4556 | 4571 | 22673 | 22688 | GTAACTGACACGCACA | 49 | 979 |
| 881669 | 4618 | 4633 | 22735 | 22750 | GGGCATGTGACTGGAG | 50 | 980 |
| 881693 | 4845 | 4860 | 22962 | 22977 | GTAACAGGCTATCAGG | 55 | 981 |
| 881717 | 5152 | 5167 | 23269 | 23284 | GCAAAACGCAGAGCCA | 43 | 982 |
| 881741 | 5209 | 5224 | 23326 | 23341 | ACGACAGCATAGCATT | 33 | 983 |
| 881765 | N/A | N/A | 18783 | 18798 | TATATGACGACTTAAG | 70 | 984 |
| 881789 | N/A | N/A | 18853 | 18868 | TCCTGAATTTACAGCA | 52 | 985 |
| 881834 | N/A | N/A | 4404 | 4419 | CGGGAGAGCGGAGGCG | 100 | 986 |
| 881857 | N/A | N/A | 4740 | 4755 | CCGCACTCACTCGCAG | 92 | 987 |
| 881881 | N/A | N/A | 5057 | 5072 | CCACGAGGCACCGCAC | 119 | 988 |
| 881905 | N/A | N/A | 5668 | 5683 | ACGAGAACGCACGGAC | 60 | 989 |
| 881927 | N/A | N/A | 5779 | 5794 | AGACGAAAACAGCCGC | 75 | 990 |
| 881949 | N/A | N/A | 6209 | 6224 | ACTAAGGACAGCTGTG | 85 | 991 |
| 881972 | N/A | N/A | 6424 | 6439 | GAAAGAATGGCGCATA | 51 | 992 |
| 881995 | N/A | N/A | 7168 | 7183 | TTCAACTTGTGACCCA | 51 | 993 |
| 882019 | N/A | N/A | 7385 | 7400 | TGCATAGTGATGAGAT | 63 | 994 |
| 882043 | N/A | N/A | 7726 | 7741 | TAACACGGTGTTGACA | 65 | 995 |
| 882067 | N/A | N/A | 8147 | 8162 | TCCAACAGGCGGACAC | 71 | 996 |
| 882090 | N/A | N/A | 8399 | 8414 | GATCATAAAGGACAAT | 70 | 997 |
| 882114 | N/A | N/A | 8570<br>8622<br>8674<br>8726<br>8778<br>8830<br>8882<br>8934<br>8986<br>9038<br>9090 | 8585<br>8637<br>8689<br>8741<br>8793<br>8845<br>8897<br>8949<br>9001<br>9053<br>9105 | AAGGAGTGCAGGAGAG | 87 | 998 |
| 882137 | N/A | N/A | 9387 | 9402 | GAGAAAACCCCCCTCT | 83 | 999 |
| 882160 | N/A | N/A | 9611 | 9626 | ACACACCACTATTCGA | 65 | 1000 |
| 882184 | N/A | N/A | 9990 | 10005 | CAAGGATAACCTGAAC | 74 | 1001 |
| 882207 | N/A | N/A | 10179 | 10194 | GCAGTAAACGCAAGTC | 46 | 1002 |
| 882231 | N/A | N/A | 10357 | 10372 | CTGAAGACAATGTTGT | 45 | 1003 |
| 882255 | N/A | N/A | 10672 | 10687 | TAGCAGGGCACGCTCT | 69 | 1004 |
| 882279 | N/A | N/A | 11090 | 11105 | TCCTAAATCACCCTGG | 79 | 1005 |
| 882303 | N/A | N/A | 11370 | 11385 | ACCAGAACTAATGTCC | 68 | 1006 |
| 882327 | N/A | N/A | 11674 | 11689 | GGCAAGATGAGAATTC | 75 | 1007 |
| 882351 | N/A | N/A | 11987 | 12002 | GAGATATAAATAGCTG | 49 | 1008 |
| 882375 | N/A | N/A | 12175 | 12190 | AACTATCTTATTCCTC | 70 | 1009 |
| 882422 | N/A | N/A | 12897 | 12912 | AAAAATATAACGGTGT | 76 | 1010 |

TABLE 15-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882445 | N/A | N/A | 13203 | 13218 | AACACTTGGAGAAGTC | 57 | 1011 |
| 882467 | N/A | N/A | 13904 | 13919 | AGTCAAGCCCCAAGCC | 87 | 1012 |
| 882489 | N/A | N/A | 14161 | 14176 | GCATGAGGGTGACACA | 58 | 1013 |
| 882512 | N/A | N/A | 14432 | 14447 | TCCCACGCGGGAGGCT | 99 | 1014 |
| 882535 | N/A | N/A | 14717 | 14732 | GGACATATTTGCTTTG | 68 | 1015 |
| 882559 | N/A | N/A | 15501 | 15516 | TTCCAGCTTAGTCACC | 63 | 1016 |
| 882582 | N/A | N/A | 15806 | 15821 | CCTAGATAACATGAGA | 74 | 1017 |
| 882605 | N/A | N/A | 15927 | 15942 | CCCAAATGACTTAGTC | 68 | 1018 |
| 882629 | N/A | N/A | 16178 | 16193 | ACAATAAAATGTCACG | 71 | 1019 |
| 882652 | N/A | N/A | 16394 | 16409 | CTCCAGGGATGGAACA | 81 | 1020 |
| 882676 | N/A | N/A | 16705 | 16720 | GACCACAGTGAAGTCG | 86 | 1021 |
| 882700 | N/A | N/A | 16926 | 16941 | GCTTACTGTGATTCTG | 66 | 1022 |
| 882724 | N/A | N/A | 17241 | 17256 | AAGGGTTACGCTTATT | 48 | 1023 |
| 882748 | N/A | N/A | 17545 | 17560 | ATGGATAGTTTCTCAT | 75 | 1024 |
| 882772 | N/A | N/A | 17760 | 17775 | TCCTAACCCTACCCTT | 70 | 1025 |
| 882796 | N/A | N/A | 17991 | 18006 | GAAATAGCATCAGAGC | 55 | 1026 |
| 882819 | N/A | N/A | 18601 | 18616 | ATCCATGTCAACTTTA | 41 | 1027 |
| 882843 | N/A | N/A | 18965 | 18980 | CAAAACTACTATTGTG | 77 | 1028 |
| 882866 | N/A | N/A | 19241 | 19256 | AGCCAAAGTGACTTAA | 42 | 1029 |
| 882892 | N/A | N/A | 4089 | 4104 | CGACAGTCCGGTTAGC | 89 | 1030 |
| 882904 | N/A | N/A | 12597 | 12612 | TTCCACACTGGATATG | 59 | 1031 |

TABLE 16

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 39 | 195 |
| 881078 | 14 | 29 | 3753 | 3768 | ATCGAGCGGTGAAACT | 71 | 1032 |
| 881102 | 357 | 372 | 6836 | 6851 | TCGGAACTTTCCTTTA | 67 | 1033 |
| 881125 | 692 | 707 | 9182 | 9197 | CATTGGTACGGGATTT | 84 | 1034 |
| 881172 | 1208 | 1223 | 13761 | 13776 | GACAAGAACTGCTGTG | 85 | 1035 |
| 881196 | 1444 | 1459 | 19561 | 19576 | GGATAGATCTGTGGTA | 51 | 1036 |
| 881220 | 1745 | 1760 | 19862 | 19877 | CAAAACAGTAAGAGGG | 69 | 1037 |
| 881244 | 1950 | 1965 | 20067 | 20082 | GCGCATTTCAGTAAAT | 67 | 1038 |
| 881268 | 2046 | 2061 | 20163 | 20178 | CATACCTACAAGCAGT | 57 | 1039 |
| 881292 | 2199 | 2214 | 20316 | 20331 | CAAGGCTACAGGCACG | 49 | 1040 |

TABLE 16-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881316 | 2389 | 2404 | 20506 | 20521 | ACATTACTAGATTGTA | 59 | 1041 |
| 881340 | 2525 | 2540 | 20642 | 20657 | TTGGACAGAAGGGCAA | 71 | 1042 |
| 881364 | 2710 | 2725 | 20827 | 20842 | AAACAGCCCACTGAGT | 89 | 1043 |
| 881388 | 2830 | 2845 | 20947 | 20962 | TAAGCAAGTGGAGGTC | 53 | 1044 |
| 881412 | 2914 | 2929 | 21031 | 21046 | AGTATGAGAAACGGCC | 38 | 1045 |
| 881436 | 3050 | 3065 | 21167 | 21182 | TGTAATGTAGGGATAC | 47 | 1046 |
| 881460 | 3343 | 3358 | 21460 | 21475 | GCAAGATGACTCCATG | 37 | 1047 |
| 881484 | 3431 | 3446 | 21548 | 21563 | ATGGCAGTGGAGCTCC | 44 | 1048 |
| 881508 | 3520 | 3535 | 21637 | 21652 | ATACATCACTGCAGTT | 64 | 1049 |
| 881531 | 3643 | 3658 | 21760 | 21775 | GGGTTAAATATTCTTC | 48 | 1050 |
| 881555 | 3919 | 3934 | 22036 | 22051 | TCATAGCTAGTTCATT | 48 | 1051 |
| 881579 | 4125 | 4140 | 22242 | 22257 | AACCAAGAAATGCACC | 67 | 1052 |
| 881598 | 4306 | 4321 | 22423 | 22438 | CCAATAGTCTAGCTGG | 81 | 1053 |
| 881622 | 4419 | 4434 | 22536 | 22551 | TCAAACACTAATACCT | 75 | 1054 |
| 881646 | 4557 | 4572 | 22674 | 22689 | AGTAACTGACACGCAC | 49 | 1055 |
| 881670 | 4667 | 4682 | 22784 | 22799 | TTAACCAATCCCAACA | 70 | 1056 |
| 881694 | 4846 | 4861 | 22963 | 22978 | TGTAACAGGCTATCAG | 69 | 1057 |
| 881718 | 5153 | 5168 | 23270 | 23285 | AGCAAAACGCAGAGCC | 39 | 1058 |
| 881742 | 5210 | 5225 | 23327 | 23342 | AACGACAGCATAGCAT | 26 | 1059 |
| 881766 | N/A | N/A | 18784 | 18799 | ATATATGACGACTTAA | 94 | 1060 |
| 881790 | N/A | N/A | 18871 | 18886 | GCCTTAATGTTCAGCT | 51 | 1061 |
| 881811 | N/A | N/A | 4126 | 4141 | GCCTTGGACGGCCCCG | 77 | 1062 |
| 881835 | N/A | N/A | 4416 | 4431 | CCGGAGCAGGCCCGGG | 113 | 1063 |
| 881858 | N/A | N/A | 4806 | 4821 | CCGACACGCGCCGCTC | 70 | 1064 |
| 881882 | N/A | N/A | 5059 | 5074 | AGCCACGAGGCACCGC | 88 | 1065 |
| 881906 | N/A | N/A | 5672 | 5687 | GGAAACGAGAACGCAC | 70 | 1066 |
| 881928 | N/A | N/A | 5783 | 5798 | TGAGAGACGAAAACAG | 109 | 1067 |
| 881950 | N/A | N/A | 6216 | 6231 | GCCTAGGACTAAGGAC | 67 | 1068 |
| 881973 | N/A | N/A | 6426 | 6441 | AAGAAAGAATGGCGCA | 37 | 1069 |
| 881996 | N/A | N/A | 7187 | 7202 | TGCTGAACCCCACAGG | 67 | 1070 |
| 882020 | N/A | N/A | 7386 | 7401 | ATGCATAGTGATGAGA | 55 | 1071 |
| 882044 | N/A | N/A | 7728 | 7743 | CATAACACGGTGTTGA | 64 | 1072 |
| 882068 | N/A | N/A | 8148 | 8163 | TTCCAACAGGCGGACA | 57 | 1073 |
| 882091 | N/A | N/A | 8406 | 8421 | CATGGAGGATCATAAA | 78 | 1074 |

TABLE 16-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882115 | N/A | N/A | 8598<br>8650<br>9014 | 8613<br>8665<br>9029 | AGGAAGCACTGGCATC | 43 | 1075 |
| 882138 | N/A | N/A | 9424 | 9439 | TAAACTTGGCTGTGGG | 73 | 1076 |
| 882161 | N/A | N/A | 9632 | 9647 | TTCCAACAATAGCAAC | 54 | 1077 |
| 882208 | N/A | N/A | 10181 | 10196 | GAGCAGTAAACGCAAG | 46 | 1078 |
| 882232 | N/A | N/A | 10367 | 10382 | AACCATGTTCCTGAAG | 59 | 1079 |
| 882256 | N/A | N/A | 10674 | 10689 | ACTAGCAGGGCACGCT | 62 | 1080 |
| 882280 | N/A | N/A | 11101 | 11116 | TCTAATGGTGCTCCTA | 49 | 1081 |
| 882304 | N/A | N/A | 11378 | 11393 | GATGAGGGACCAGAAC | 80 | 1082 |
| 882328 | N/A | N/A | 11675 | 11690 | GGGCAAGATGAGAATT | 100 | 1083 |
| 882352 | N/A | N/A | 11989 | 12004 | CCGAGATATAAATAGC | 39 | 1084 |
| 882376 | N/A | N/A | 12206 | 12221 | TATCATGCATACCAAA | 42 | 1085 |
| 882399 | N/A | N/A | 12654 | 12669 | TGGTAGAATGTGATAT | 57 | 1086 |
| 882423 | N/A | N/A | 12900 | 12915 | GCAAAAATATAACGG | 53 | 1087 |
| 882446 | N/A | N/A | 13275 | 13290 | CGTCAAGGAGGCCTGG | 57 | 1088 |
| 882468 | N/A | N/A | 13913 | 13928 | CTCTACTGGAGTCAAG | 75 | 1089 |
| 882490 | N/A | N/A | 14162 | 14177 | TGCATGAGGGTGACAC | 55 | 1090 |
| 882513 | N/A | N/A | 14458 | 14473 | GGCGAGTGGCGGGTAG | 92 | 1091 |
| 882536 | N/A | N/A | 14736 | 14751 | CTGAAGCTTAGTTATC | 62 | 1092 |
| 882560 | N/A | N/A | 15515 | 15530 | ACTCAATGTGCACCTT | 71 | 1093 |
| 882583 | N/A | N/A | 15807 | 15822 | CCCTAGATAACATGAG | 83 | 1094 |
| 882606 | N/A | N/A | 15982 | 15997 | ACTTACAGGACTATTT | 84 | 1095 |
| 882630 | N/A | N/A | 16200 | 16215 | GACAAATCTTCTGCCT | 74 | 1096 |
| 882653 | N/A | N/A | 16422 | 16437 | TGTAACTCTGAGTAGA | 57 | 1097 |
| 882677 | N/A | N/A | 16708 | 16723 | GTAGACCACAGTGAAG | 71 | 1098 |
| 882701 | N/A | N/A | 16934 | 16949 | AAGCAAGAGCTTACTG | 86 | 1099 |
| 882725 | N/A | N/A | 17246 | 17261 | AGTTTAAGGGTTACGC | 37 | 1100 |
| 882749 | N/A | N/A | 17546 | 17561 | AATGGATAGTTTCTCA | 37 | 1101 |
| 882773 | N/A | N/A | 17771 | 17786 | TCTAACCCTAATCCTA | 95 | 1102 |
| 882797 | N/A | N/A | 18030 | 18045 | GTTCAAGATTAAACCA | 29 | 1103 |
| 882820 | N/A | N/A | 18605 | 18620 | TTGCATCCATGTCAAC | 53 | 1104 |
| 882844 | N/A | N/A | 19017 | 19032 | GTATAGTTCTCAACCA | 53 | 1105 |
| 882867 | N/A | N/A | 19266 | 19281 | TCCATAGATCAACATG | 55 | 1106 |
| 882903 | N/A | N/A | 9991 | 10006 | CCAAGGATAACCTGAA | 56 | 1107 |

TABLE 17

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 37 | 195 |
| 881079 | 15 | 30 | 3754 | 3769 | GATCGAGCGGTGAAAC | 77 | 1108 |
| 881103 | 412 | 427 | 6891 | 6906 | AAGCGCACCGCAGGCG | 96 | 1109 |
| 881126 | 694 | 709 | 9184 | 9199 | GACATTGGTACGGGAT | 64 | 1110 |
| 881173 | 1209 | 1224 | 13762 | 13777 | TGACAAGAACTGCTGT | 82 | 1111 |
| 881197 | 1446 | 1461 | 19563 | 19578 | GCGGATAGATCTGTGG | 45 | 1112 |
| 881221 | 1777 | 1792 | 19894 | 19909 | CGCTGAACTGAAATCT | 63 | 1113 |
| 881245 | 1955 | 1970 | 20072 | 20087 | AAAGAGCGCATTTCAG | 94 | 1114 |
| 881269 | 2047 | 2062 | 20164 | 20179 | ACATACCTACAAGCAG | 55 | 1115 |
| 881293 | 2202 | 2217 | 20319 | 20334 | CCCCAAGGCTACAGGC | 75 | 1116 |
| 881317 | 2391 | 2406 | 20508 | 20523 | AGACATTACTAGATTG | 34 | 1117 |
| 881341 | 2530 | 2545 | 20647 | 20662 | AGTACTTGGACAGAAG | 57 | 1118 |
| 881365 | 2740 | 2755 | 20857 | 20872 | GAGGAAGCATAGAACA | 82 | 1119 |
| 881389 | 2832 | 2847 | 20949 | 20964 | CTTAAGCAAGTGGAGG | 30 | 1120 |
| 881413 | 2915 | 2930 | 21032 | 21047 | TAGTATGAGAAACGGC | 22 | 1121 |
| 881437 | 3051 | 3066 | 21168 | 21183 | GTGTAATGTAGGGATA | 36 | 1122 |
| 881461 | 3344 | 3359 | 21461 | 21476 | TGCAAGATGACTCCAT | 43 | 1123 |
| 881485 | 3433 | 3448 | 21550 | 21565 | ACATGGCAGTGGAGCT | 36 | 1124 |
| 881509 | 3522 | 3537 | 21639 | 21654 | GTATACATCACTGCAG | 56 | 1125 |
| 881532 | 3660 | 3675 | 21777 | 21792 | CTTTGAAGTGCTGTGT | 84 | 1126 |
| 881556 | 3920 | 3935 | 22037 | 22052 | TTCATAGCTAGTTCAT | 56 | 1127 |
| 881580 | 4168 | 4183 | 22285 | 22300 | TTGAGGTTTTCCTAAA | 71 | 1128 |
| 881599 | 4307 | 4322 | 22424 | 22439 | CCCAATAGTCTAGCTG | 44 | 1129 |
| 881623 | 4430 | 4445 | 22547 | 22562 | GACCAGCTTTTTCAAA | 62 | 1130 |
| 881647 | 4558 | 4573 | 22675 | 22690 | AAGTAACTGACACGCA | 77 | 1131 |
| 881671 | 4670 | 4685 | 22787 | 22802 | ACCTTAACCAATCCCA | 29 | 1132 |
| 881695 | 4847 | 4862 | 22964 | 22979 | CTGTAACAGGCTATCA | 56 | 1133 |
| 881719 | 5154 | 5169 | 23271 | 23286 | CAGCAAAACGCAGAGC | 46 | 1134 |
| 881743 | 5212 | 5227 | 23329 | 23344 | CCAACGACAGCATAGC | 24 | 1135 |
| 881767 | N/A | N/A | 18785 | 18800 | TATATATGACGACTTA | 80 | 1136 |
| 881791 | N/A | N/A | 18872 | 18887 | CGCCTTAATGTTCAGC | 34 | 1137 |
| 881812 | N/A | N/A | 4152 | 4167 | AGGCAGTTGTGCCGTC | 162 | 1138 |
| 881836 | N/A | N/A | 4423 | 4438 | CCGGACCCCGGAGCAG | 124 | 1139 |
| 881859 | N/A | N/A | 4807 | 4822 | CCCGACACGCGCCGCT | 88 | 1140 |
| 881883 | N/A | N/A | 5062 | 5077 | TTCAGCCACGAGGCAC | 95 | 1141 |
| 881907 | N/A | N/A | 5674 | 5689 | GTGGAAACGAGAACGC | 97 | 1142 |
| 881929 | N/A | N/A | 5794 | 5809 | CAGAGACGCGGTGAGA | 161 | 1143 |

TABLE 17-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881951 | N/A | N/A | 6217 | 6232 | TGCCTAGGACTAAGGA | 74 | 1144 |
| 881974 | N/A | N/A | 6479 | 6494 | GCTAAACCCAAAATAC | 96 | 1145 |
| 881997 | N/A | N/A | 7192 | 7207 | TCCTATGCTGAACCCC | 64 | 1146 |
| 882021 | N/A | N/A | 7390 | 7405 | TACCATGCATAGTGAT | 56 | 1147 |
| 882045 | N/A | N/A | 7730 | 7745 | TGCATAACACGGTGTT | 62 | 1148 |
| 882069 | N/A | N/A | 8153 | 8168 | GCATATTCCAACAGGC | 34 | 1149 |
| 882092 | N/A | N/A | 8409 | 8424 | ACTCATGGAGGATCAT | 81 | 1150 |
| 882116 | N/A | N/A | 8599 8651 8755 8859 8911 9015 | 8614 8666 8770 8874 8926 9030 | TAGGAAGCACTGGCAT | 72 | 1151 |
| 882139 | N/A | N/A | 9425 | 9440 | GTAAACTTGGCTGTGG | 82 | 1152 |
| 882162 | N/A | N/A | 9669 | 9684 | TGGTATTTTTCCGTTC | 31 | 1153 |
| 882185 | N/A | N/A | 9992 | 10007 | GCCAAGGATAACCTGA | 31 | 1154 |
| 882209 | N/A | N/A | 10186 | 10201 | AGCCAGAGCAGTAAAC | 85 | 1155 |
| 882233 | N/A | N/A | 10371 | 10386 | ACTGAACCATGTTCCT | 49 | 1156 |
| 882257 | N/A | N/A | 10676 | 10691 | CAACTAGCAGGGCACG | 62 | 1157 |
| 882281 | N/A | N/A | 11102 | 11117 | TTCTAATGGTGCTCCT | 93 | 1158 |
| 882305 | N/A | N/A | 11396 | 11411 | GCACATCAATGTTTTA | 33 | 1159 |
| 882329 | N/A | N/A | 11687 | 11702 | AAAGATGCCAGAGGGC | 77 | 1160 |
| 882353 | N/A | N/A | 11991 | 12006 | TGCCGAGATATAAATA | 77 | 1161 |
| 882377 | N/A | N/A | 12207 | 12222 | GTATCATGCATACCAA | 35 | 1162 |
| 882400 | N/A | N/A | 12675 | 12690 | GCCTTAATGGTGATTT | 74 | 1163 |
| 882447 | N/A | N/A | 13289 | 13304 | ACAAAGGTTCCCGCG | 97 | 1164 |
| 882469 | N/A | N/A | 13921 | 13936 | CAGAAGATCTCTACTG | 88 | 1165 |
| 882491 | N/A | N/A | 14163 | 14178 | CTGCATGAGGGTGACA | 81 | 1166 |
| 882514 | N/A | N/A | 14477 | 14492 | GAAGAGTTGGCGGTGG | 85 | 1167 |
| 882537 | N/A | N/A | 14737 | 14752 | CCTGAAGCTTAGTTAT | 65 | 1168 |
| 882561 | N/A | N/A | 15531 | 15546 | ACGCAGTGCACCTGTG | 107 | 1169 |
| 882584 | N/A | N/A | 15813 | 15828 | CTCCAACCCTAGATAA | 98 | 1170 |
| 882607 | N/A | N/A | 15983 | 15998 | AACTTACAGGACTATT | 87 | 1171 |
| 882631 | N/A | N/A | 16201 | 16216 | AGACAAATCTTCTGCC | 104 | 1172 |
| 882654 | N/A | N/A | 16430 | 16445 | CTGAACTGTGTAACTC | 72 | 1173 |
| 882678 | N/A | N/A | 16710 | 16725 | TAGTAGACCACAGTGA | 91 | 1174 |
| 882702 | N/A | N/A | 16950 | 16965 | CACCAGGTTAAACAGG | 108 | 1175 |
| 882726 | N/A | N/A | 17247 | 17262 | TAGTTTAAGGGTTACG | 51 | 1176 |
| 882750 | N/A | N/A | 17554 | 17569 | CTCCAGGGAATGGATA | 73 | 1177 |
| 882774 | N/A | N/A | 17777 | 17792 | GAAAACTCTAACCCTA | 91 | 1178 |

TABLE 17-continued

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882798 | N/A | N/A | 18087 | 18102 | TTATATACTGGTTGGT | 51 | 1179 |
| 882821 | N/A | N/A | 18620 | 18635 | TTAGAGGACAGTGACT | 82 | 1180 |
| 882845 | N/A | N/A | 19018 | 19033 | TGTATAGTTCTCAACC | 57 | 1181 |
| 882868 | N/A | N/A | 19267 | 19282 | TTCCATAGATCAACAT | 56 | 1182 |
| 882905 | N/A | N/A | 12921 | 12936 | CCCTAAGTTTAATTTA | 103 | 1183 |

TABLE 18

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 38 | 195 |
| 881080 | 16 | 31 | 3755 | 3770 | AGATCGAGCGGTGAAA | 76 | 1184 |
| 881104 | 415 | 430 | 6894 | 6909 | TCAAAGCGCACCGCAG | 57 | 1185 |
| 881127 | 697 | 712 | 9187 | 9202 | TGGGACATTGGTACGG | 31 | 1186 |
| 881174 | 1210 | 1225 | 13763 | 13778 | CTGACAAGAACTGCTG | 79 | 1187 |
| 881198 | 1447 | 1462 | 19564 | 19579 | GGCGGATAGATCTGTG | 49 | 1188 |
| 881222 | 1780 | 1795 | 19897 | 19912 | AACCGCTGAACTGAAA | 87 | 1189 |
| 881246 | 1957 | 1972 | 20074 | 20089 | TTAAAGAGCGCATTTC | 59 | 1190 |
| 881270 | 2048 | 2063 | 20165 | 20180 | GACATACCTACAAGCA | 50 | 1191 |
| 881294 | 2229 | 2244 | 20346 | 20361 | AACCGCTGGCAGGTGG | 60 | 1192 |
| 881318 | 2393 | 2408 | 20510 | 20525 | TTAGACATTACTAGAT | 55 | 1193 |
| 881342 | 2531 | 2546 | 20648 | 20663 | AAGTACTTGGACAGAA | 46 | 1194 |
| 881366 | 2743 | 2758 | 20860 | 20875 | CACGAGGAAGCATAGA | 44 | 1195 |
| 881390 | 2833 | 2848 | 20950 | 20965 | ACTTAAGCAAGTGGAG | 37 | 1196 |
| 881414 | 2917 | 2932 | 21034 | 21049 | TGTAGTATGAGAAACG | 31 | 1197 |
| 881438 | 3059 | 3074 | 21176 | 21191 | GCTGAACTGTGTAATG | 42 | 1198 |
| 881462 | 3345 | 3360 | 21462 | 21477 | GTGCAAGATGACTCCA | 44 | 1199 |
| 881486 | 3435 | 3450 | 21552 | 21567 | GTACATGGCAGTGGAG | 44 | 1200 |
| 881510 | 3523 | 3538 | 21640 | 21655 | TGTATACATCACTGCA | 37 | 1201 |
| 881533 | 3665 | 3680 | 21782 | 21797 | AGCTTCTTTGAAGTGC | 38 | 1202 |
| 881557 | 3921 | 3936 | 22038 | 22053 | TTTCATAGCTAGTTCA | 44 | 1203 |
| 881581 | 4170 | 4185 | 22287 | 22302 | GCTTGAGGTTTTCCTA | 23 | 1204 |
| 881600 | 4312 | 4327 | 22429 | 22444 | TCATACCCAATAGTCT | 48 | 1205 |
| 881624 | 4438 | 4453 | 22555 | 22570 | CGCTCAAAGACCAGCT | 44 | 1206 |
| 881648 | 4559 | 4574 | 22676 | 22691 | AAAGTAACTGACACGC | 33 | 1207 |
| 881672 | 4671 | 4686 | 22788 | 22803 | GACCTTAACCAATCCC | 36 | 1208 |

TABLE 18-continued

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881696 | 4863 | 4878 | 22980 | 22995 | GACCTTTACTTCATTC | 48 | 1209 |
| 881720 | 5157 | 5172 | 23274 | 23289 | TCTCAGCAAAACGCAG | 73 | 1210 |
| 881744 | 5213 | 5228 | 23330 | 23345 | ACCAACGACAGCATAG | 33 | 1211 |
| 881768 | N/A | N/A | 18786 | 18801 | TTATATATGACGACTT | 65 | 1212 |
| 881813 | N/A | N/A | 4156 | 4171 | TCGCAGGCAGTTGTGC | 120 | 1213 |
| 881837 | N/A | N/A | 4425 | 4440 | CGCCGGACCCCGGAGC | 91 | 1214 |
| 881860 | N/A | N/A | 4816 | 4831 | CCAAAGGCTCCCGACA | 71 | 1215 |
| 881884 | N/A | N/A | 5065 | 5080 | CCCTTCAGCCACGAGG | 92 | 1216 |
| 881908 | N/A | N/A | 5675 | 5690 | CGTGGAAACGAGAACG | 71 | 1217 |
| 881952 | N/A | N/A | 6229 | 6244 | TCTGAGTGAGCTTGCC | 51 | 1218 |
| 881975 | N/A | N/A | 6541 | 6556 | TGCATAGGCATCCTTC | 32 | 1219 |
| 881998 | N/A | N/A | 7200 | 7215 | ATTAATTCTCCTATGC | 85 | 1220 |
| 882022 | N/A | N/A | 7393 | 7408 | TATTACCATGCATAGT | 70 | 1221 |
| 882046 | N/A | N/A | 7732 | 7747 | AATGCATAACACGGTG | 51 | 1222 |
| 882070 | N/A | N/A | 8154 | 8169 | AGCATATTCCAACAGG | 31 | 1223 |
| 882093 | N/A | N/A | 8417 | 8432 | GTGAAAACACTCATGG | 40 | 1224 |
| 882117 | N/A | N/A | 8606 8658 8762 8866 8918 9022 | 8621 8673 8777 8881 8933 9037 | GCTGAGATAGGAAGCA | 81 | 1225 |
| 882140 | N/A | N/A | 9426 | 9441 | AGTAAACTTGGCTGTG | 62 | 1226 |
| 882163 | N/A | N/A | 9710 | 9725 | TGGTAGGTAGGCACCT | 65 | 1227 |
| 882186 | N/A | N/A | 10006 | 10021 | CTTCACTACCTGCAGC | 78 | 1228 |
| 882210 | N/A | N/A | 10190 | 10205 | ATAGAGCCAGAGCAGT | 34 | 1229 |
| 882234 | N/A | N/A | 10372 | 10387 | CACTGAACCATGTTCC | 39 | 1230 |
| 882258 | N/A | N/A | 10677 | 10692 | GCAACTAGCAGGGCAC | 47 | 1231 |
| 882282 | N/A | N/A | 11116 | 11131 | AGTGATGTCAGGTTTT | 28 | 1232 |
| 882306 | N/A | N/A | 11398 | 11413 | AGGCACATCAATGTTT | 49 | 1233 |
| 882330 | N/A | N/A | 11688 | 11703 | TAAAGATGCCAGAGGG | 61 | 1234 |
| 882354 | N/A | N/A | 11999 | 12014 | CACGAGGTTGCCGAGA | 36 | 1235 |
| 882378 | N/A | N/A | 12209 | 12224 | CTGTATCATGCATACC | 39 | 1236 |
| 882401 | N/A | N/A | 12682 | 12697 | CACTGAGGCCTTAATG | 66 | 1237 |
| 882424 | N/A | N/A | 12927 | 12942 | AATGAACCCTAAGTTT | 97 | 1238 |
| 882448 | N/A | N/A | 13290 | 13305 | AACAAAAGGTTCCCGC | 60 | 1239 |
| 882470 | N/A | N/A | 13922 | 13937 | ACAGAAGATCTCTACT | 68 | 1240 |
| 882492 | N/A | N/A | 14205 | 14220 | GTACAGTCCACTCCAC | 90 | 1241 |
| 882515 | N/A | N/A | 14550 | 14565 | GGCACATGAGAAATCA | 67 | 1242 |
| 882538 | N/A | N/A | 14993 | 15008 | AACTGCAGCACCGTGG | 55 | 1243 |

TABLE 18-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882562 | N/A | N/A | 15533 | 15548 | TCACGCAGTGCACCTG | 54 | 1244 |
| 882585 | N/A | N/A | 15826 | 15841 | TGAGAAAGCATGGCTC | 60 | 1245 |
| 882608 | N/A | N/A | 15987 | 16002 | AGCTAACTTACAGGAC | 104 | 1246 |
| 882632 | N/A | N/A | 16208 | 16223 | GTACACAAGACAAATC | 79 | 1247 |
| 882655 | N/A | N/A | 16433 | 16448 | TGCCTGAACTGTGTAA | 65 | 1248 |
| 882679 | N/A | N/A | 16713 | 16728 | AGGTAGTAGACCACAG | 41 | 1249 |
| 882703 | N/A | N/A | 16955 | 16970 | GAACACACCAGGTTAA | 102 | 1250 |
| 882727 | N/A | N/A | 17248 | 17263 | CTAGTTTAAGGGTTAC | 73 | 1251 |
| 882751 | N/A | N/A | 17565 | 17580 | CTACAAAATGCCTCCA | 58 | 1252 |
| 882775 | N/A | N/A | 17778 | 17793 | AGAAAACTCTAACCCT | 75 | 1253 |
| 882799 | N/A | N/A | 18089 | 18104 | GATTATATACTGGTTG | 41 | 1254 |
| 882822 | N/A | N/A | 18623 | 18638 | GACTTAGAGGACAGTG | 52 | 1255 |
| 882846 | N/A | N/A | 19019 | 19034 | CTGTATAGTTCTCAAC | 48 | 1256 |
| 882869 | N/A | N/A | 19283 | 19298 | ATTTTTTGGTTAGTCC | 47 | 1257 |
| 882896 | N/A | N/A | 5796 | 5811 | AACAGAGACGCGGTGA | 90 | 1258 |

TABLE 19

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 38 | 195 |
| 881081 | 18 | 33 | 3757 | 3772 | CAAGATCGAGCGGTGA | 62 | 1259 |
| 881105 | 416 | 431 | 6895 | 6910 | TTCAAAGCGCACCGCA | 51 | 1260 |
| 881128 | 728 | 743 | 9218 | 9233 | TGCCAGTGGTGGCCGC | 70 | 1261 |
| 881175 | 1211 | 1226 | N/A | N/A | TCTGACAAGAACTGCT | 88 | 1262 |
| 881199 | 1448 | 1463 | 19565 | 19580 | TGGCGGATAGATCTGT | 66 | 1263 |
| 881223 | 1784 | 1799 | 19901 | 19916 | CCTCAACCGCTGAACT | 70 | 1264 |
| 881247 | 1958 | 1973 | 20075 | 20090 | ATTAAAGAGCGCATTT | 87 | 1265 |
| 881271 | 2049 | 2064 | 20166 | 20181 | AGACATACCTACAAGC | 50 | 1266 |
| 881295 | 2233 | 2248 | 20350 | 20365 | AGGAAACCGCTGGCAG | 44 | 1267 |
| 881319 | 2395 | 2410 | 20512 | 20527 | ACTTAGACATTACTAG | 80 | 1268 |
| 881343 | 2534 | 2549 | 20651 | 20666 | GTTAAGTACTTGGACA | 68 | 1269 |
| 881367 | 2745 | 2760 | 20862 | 20877 | GGCACGAGGAAGCATA | 38 | 1270 |
| 881391 | 2835 | 2850 | 20952 | 20967 | ATACTTAAGCAAGTGG | 24 | 1271 |
| 881415 | 2918 | 2933 | 21035 | 21050 | CTGTAGTATGAGAAAC | 55 | 1272 |
| 881439 | 3066 | 3081 | 21183 | 21198 | GATAAAGGCTGAACTG | 33 | 1273 |

TABLE 19-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881463 | 3359 | 3374 | 21476 | 21491 | CTGCATGAAAGTGTGT | 44 | 1274 |
| 881487 | 3443 | 3458 | 21560 | 21575 | CCTACTGGGTACATGG | 37 | 1275 |
| 881511 | 3524 | 3539 | 21641 | 21656 | ATGTATACATCACTGC | 33 | 1276 |
| 881534 | 3686 | 3701 | 21803 | 21818 | CCTGAGACAGACTTCC | 45 | 1277 |
| 881558 | 3924 | 3939 | 22041 | 22056 | GTATTTCATAGCTAGT | 31 | 1278 |
| 881582 | 4172 | 4187 | 22289 | 22304 | CTGCTTGAGGTTTTCC | 26 | 1279 |
| 881601 | 4314 | 4329 | 22431 | 22446 | GTTCATACCCAATAGT | 34 | 1280 |
| 881625 | 4449 | 4464 | 22566 | 22581 | ATTTATGCCCTCGCTC | 74 | 1281 |
| 881649 | 4560 | 4575 | 22677 | 22692 | AAAAGTAACTGACACG | 39 | 1282 |
| 881673 | 4675 | 4690 | 22792 | 22807 | TAAAGACCTTAACCAA | 70 | 1283 |
| 881697 | 4909 | 4924 | 23026 | 23041 | TTATGCATGTTCCTCA | 43 | 1284 |
| 881721 | 5164 | 5179 | 23281 | 23296 | CTACAGATCTCAGCAA | 82 | 1285 |
| 881745 | 5216 | 5231 | 23333 | 23348 | TATACCAACGACAGCA | 51 | 1286 |
| 881769 | N/A | N/A | 18787 | 18802 | TTTATATATGACGACT | 61 | 1287 |
| 881793 | N/A | N/A | 19455 | 19470 | TAGCAGAGGTTCTACC | 74 | 1288 |
| 881814 | N/A | N/A | 4215 | 4230 | AGGAACGAAGAGCAGG | 57 | 1289 |
| 881838 | N/A | N/A | 4447 | 4462 | GGGATTCCGCGCGCAG | 86 | 1290 |
| 881861 | N/A | N/A | 4818 | 4833 | GCCCAAAGGCTCCCGA | 89 | 1291 |
| 881885 | N/A | N/A | 5362 | 5377 | CCGGAGACCTTGAAGA | 91 | 1292 |
| 881930 | N/A | N/A | 5797 | 5812 | AAACAGAGACGCGGTG | 82 | 1293 |
| 881953 | N/A | N/A | 6241 | 6256 | ACCCACCCAGTGTCTG | 82 | 1294 |
| 881976 | N/A | N/A | 6542 | 6557 | TTGCATAGGCATCCTT | 53 | 1295 |
| 881999 | N/A | N/A | 7203 | 7218 | GTGATTAATTCTCCTA | 30 | 1296 |
| 882023 | N/A | N/A | 7414 | 7429 | CACTTTAAAAGTTGAC | 72 | 1297 |
| 882047 | N/A | N/A | 7733 | 7748 | GAATGCATAACACGGT | 39 | 1298 |
| 882071 | N/A | N/A | 8158 | 8173 | GAGAAGCATATTCCAA | 43 | 1299 |
| 882094 | N/A | N/A | 8431 | 8446 | CTTCATCAGACTAAGT | 69 | 1300 |
| 882118 | N/A | N/A | 8607<br>8659<br>8763<br>8867<br>8919<br>9023 | 8622<br>8674<br>8778<br>8882<br>8934<br>9038 | GGCTGAGATAGGAAGC | 64 | 1301 |
| 882141 | N/A | N/A | 9427 | 9442 | GAGTAAACTTGGCTGT | 62 | 1302 |
| 882164 | N/A | N/A | 9716 | 9731 | ACCCAGTGGTAGGTAG | 70 | 1303 |
| 882187 | N/A | N/A | 10014 | 10029 | GTACACCTCTTCACTA | 93 | 1304 |
| 882211 | N/A | N/A | 10191 | 10206 | CATAGAGCCAGAGCAG | 40 | 1305 |
| 882235 | N/A | N/A | 10448 | 10463 | GCCAAAGAGCCCAATT | 67 | 1306 |
| 882259 | N/A | N/A | 10772 | 10787 | GTCCGACGCACCGCGG | 82 | 1307 |
| 882283 | N/A | N/A | 11122 | 11137 | ACAAGCAGTGATGTCA | 27 | 1308 |

TABLE 19-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882307 | N/A | N/A | 11403 | 11418 | CTCTTAGGCACATCAA | 39 | 1309 |
| 882331 | N/A | N/A | 11689 | 11704 | TTAAAGATGCCAGAGG | 72 | 1310 |
| 882355 | N/A | N/A | 12000 | 12015 | TCACGAGGTTGCCGAG | 38 | 1311 |
| 882379 | N/A | N/A | 12221 | 12236 | CTGATAATTAATCTGT | 37 | 1312 |
| 882402 | N/A | N/A | 12689 | 12704 | GGGTAAGCACTGAGGC | 39 | 1313 |
| 882425 | N/A | N/A | 12990 | 13005 | TTTAAGTCATGTGTCA | 50 | 1314 |
| 882449 | N/A | N/A | 13291 | 13306 | GAACAAAGGTTCCCG | 82 | 1315 |
| 882471 | N/A | N/A | 13923 | 13938 | GACAGAAGATCTCTAC | 83 | 1316 |
| 882493 | N/A | N/A | 14210 | 14225 | AACCAGTACAGTCCAC | 65 | 1317 |
| 882516 | N/A | N/A | 14551 | 14566 | AGGCACATGAGAAATC | 77 | 1318 |
| 882539 | N/A | N/A | 15020 | 15035 | GGCAATGGAGTCTCGC | 50 | 1319 |
| 882563 | N/A | N/A | 15535 | 15550 | TCTCACGCAGTGCACC | 56 | 1320 |
| 882586 | N/A | N/A | 15837 | 15852 | GCACAATTCTCTGAGA | 66 | 1321 |
| 882609 | N/A | N/A | 16031 | 16046 | TATCAAAGATCTCCAC | 75 | 1322 |
| 882633 | N/A | N/A | 16231 | 16246 | CTTTAGCCCATGCTCC | 80 | 1323 |
| 882656 | N/A | N/A | 16438 | 16453 | CACTATGCCTGAACTG | 90 | 1324 |
| 882680 | N/A | N/A | 16718 | 16733 | TCAAAGGTAGTAGAC | 71 | 1325 |
| 882704 | N/A | N/A | 16959 | 16974 | CACCGAACACACCAGG | 80 | 1326 |
| 882728 | N/A | N/A | 17287 | 17302 | TCAGACTGTGCTGCTC | 64 | 1327 |
| 882752 | N/A | N/A | 17566 | 17581 | CCTACAAAATGCCTCC | 53 | 1328 |
| 882776 | N/A | N/A | 17808 | 17823 | GTTATCTATGGAAACC | 58 | 1329 |
| 882800 | N/A | N/A | 18090 | 18105 | GGATTATATACTGGTT | 23 | 1330 |
| 882823 | N/A | N/A | 18682 | 18697 | ATGGACCACGCAGCCT | 61 | 1331 |
| 882847 | N/A | N/A | 19026 | 19041 | AGGTAATCTGTATAGT | 38 | 1332 |
| 882870 | N/A | N/A | 19311 | 19326 | TTCATATTTGGAGCCA | 34 | 1333 |
| 882894 | N/A | N/A | 5700 | 5715 | GCCCGGAGGAAGGGCG | 106 | 1334 |

TABLE 20

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 26 | 195 |
| 881082 | 20 | 35 | 3759 | 3774 | CCCAAGATCGAGCGGT | 72 | 1335 |
| 881106 | 417 | 432 | 6896 | 6911 | GTTCAAAGCGCACCGC | 35 | 1336 |
| 881129 | 741 | 756 | 9231 | 9246 | ACAAGCTGGGCCTTGC | 73 | 1337 |
| 881152 | 942 | 957 | 13495 | 13510 | GGAGATCCGGCAGCCC | 77 | 1338 |

TABLE 20-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881176 | 1222 | 1237 | N/A | N/A | ACGCTTGCAGCTCTGA | 52 | 1339 |
| 881200 | 1452 | 1467 | 19569 | 19584 | GGAATGGCGGATAGAT | 67 | 1340 |
| 881224 | 1785 | 1800 | 19902 | 19917 | TCCTCAACCGCTGAAC | 63 | 1341 |
| 881248 | 1959 | 1974 | 20076 | 20091 | AATTAAAGAGCGCATT | 83 | 1342 |
| 881272 | 2050 | 2065 | 20167 | 20182 | CAGACATACCTACAAG | 56 | 1343 |
| 881296 | 2234 | 2249 | 20351 | 20366 | CAGGAAACCGCTGGCA | 26 | 1344 |
| 881320 | 2396 | 2411 | 20513 | 20528 | TACTTAGACATTACTA | 61 | 1345 |
| 881344 | 2536 | 2551 | 20653 | 20668 | TAGTTAAGTACTTGGA | 44 | 1346 |
| 881368 | 2746 | 2761 | 20863 | 20878 | TGGCACGAGGAAGCAT | 54 | 1347 |
| 881392 | 2836 | 2851 | 20953 | 20968 | TATACTTAAGCAAGTG | 53 | 1348 |
| 881416 | 2919 | 2934 | 21036 | 21051 | CCTGTAGTATGAGAAA | 43 | 1349 |
| 881440 | 3068 | 3083 | 21185 | 21200 | TTGATAAAGGCTGAAC | 33 | 1350 |
| 881464 | 3364 | 3379 | 21481 | 21496 | GAGCACTGCATGAAAG | 49 | 1351 |
| 881488 | 3444 | 3459 | 21561 | 21576 | CCCTACTGGGTACATG | 63 | 1352 |
| 881512 | 3525 | 3540 | 21642 | 21657 | GATGTATACATCACTG | 30 | 1353 |
| 881535 | 3722 | 3737 | 21839 | 21854 | GAGCATCCGCTTGGAG | 69 | 1354 |
| 881559 | 3926 | 3941 | 22043 | 22058 | GAGTATTTCATAGCTA | 29 | 1355 |
| 881583 | 4173 | 4188 | 22290 | 22305 | ACTGCTTGAGGTTTTC | 42 | 1356 |
| 881602 | 4319 | 4334 | 22436 | 22451 | TTTTAGTTCATACCCA | 48 | 1357 |
| 881626 | 4450 | 4465 | 22567 | 22582 | TATTTATGCCCTCGCT | 74 | 1358 |
| 881650 | 4576 | 4591 | 22693 | 22708 | TCTGAATTGTTACTAA | 65 | 1359 |
| 881674 | 4677 | 4692 | 22794 | 22809 | AATAAAGACCTTAACC | 89 | 1360 |
| 881698 | 4911 | 4926 | 23028 | 23043 | TCTTATGCATGTTCCT | 38 | 1361 |
| 881722 | 5176 | 5191 | 23293 | 23308 | AAGCATCCTTTCCTAC | 65 | 1362 |
| 881746 | 5217 | 5232 | 23334 | 23349 | GTATACCAACGACAGC | 22 | 1363 |
| 881770 | N/A | N/A | 18788 | 18803 | TTTTATATATGACGAC | 66 | 1364 |
| 881794 | N/A | N/A | 22820 | 22835 | GAGGACTTCGGGAGAT | 77 | 1365 |
| 881815 | N/A | N/A | 4217 | 4232 | TTAGGAACGAAGAGCA | 68 | 1366 |
| 881839 | N/A | N/A | 4487 | 4502 | GACAAGTGGCGCAGAC | 89 | 1367 |
| 881862 | N/A | N/A | 4853 | 4868 | CTCCTACCCGCCTGCT | 85 | 1368 |
| 881886 | N/A | N/A | 5364 | 5379 | GGCCGGAGACCTTGAA | 97 | 1369 |
| 881909 | N/A | N/A | 5712 | 5727 | CGGCAGACGGGAGCCC | 88 | 1370 |
| 881931 | N/A | N/A | 5798 | 5813 | GAAACAGAGACGCGGT | 99 | 1371 |
| 881954 | N/A | N/A | 6265 | 6280 | GCGGAGGTTCCTTGAG | 56 | 1372 |
| 882000 | N/A | N/A | 7211 | 7226 | CATACAGTGTGATTAA | 47 | 1373 |
| 882024 | N/A | N/A | 7424 | 7439 | GACCATGTTACACTTT | 50 | 1374 |
| 882048 | N/A | N/A | 7736 | 7751 | TTAGAATGCATAACAC | 56 | 1375 |

TABLE 20-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882072 | N/A | N/A | 8159 | 8174 | TGAGAAGCATATTCCA | 28 | 1376 |
| 882095 | N/A | N/A | 8443 | 8458 | CTGGAGTGAACCCTTC | 44 | 1377 |
| 882119 | N/A | N/A | 8701<br>8805<br>8961 | 8716<br>8820<br>8976 | AGAAGCACTGGCATCG | 63 | 1378 |
| 882142 | N/A | N/A | 9430 | 9445 | TGAGAGTAAACTTGGC | 35 | 1379 |
| 882165 | N/A | N/A | 9742 | 9757 | ATCCACAATCAGCAAG | 49 | 1380 |
| 882188 | N/A | N/A | 10016 | 10031 | TGGTACACCTCTTCAC | 68 | 1381 |
| 882212 | N/A | N/A | 10192 | 10207 | CCATAGAGCCAGAGCA | 36 | 1382 |
| 882236 | N/A | N/A | 10464 | 10479 | GTCTACTTGAGTCTGT | 49 | 1383 |
| 882260 | N/A | N/A | 10780 | 10795 | GACAGAGAGTCCGACG | 101 | 1384 |
| 882284 | N/A | N/A | 11123 | 11138 | CACAAGCAGTGATGTC | 40 | 1385 |
| 882308 | N/A | N/A | 11405 | 11420 | TACTCTTAGGCACATC | 41 | 1386 |
| 882332 | N/A | N/A | 11723 | 11738 | TCAGAATTTAGTTAGT | 67 | 1387 |
| 882356 | N/A | N/A | 12001 | 12016 | ATCACGAGGTTGCCGA | 40 | 1388 |
| 882380 | N/A | N/A | 12223 | 12238 | GGCTGATAATTAATCT | 53 | 1389 |
| 882403 | N/A | N/A | 12695 | 12710 | ATTAAAGGGTAAGCAC | 68 | 1390 |
| 882426 | N/A | N/A | 13007 | 13022 | TGATAGTGGTGATGTC | 46 | 1391 |
| 882450 | N/A | N/A | 13292 | 13307 | GGAACAAAAGGTTCCC | 88 | 1392 |
| 882472 | N/A | N/A | 13956 | 13971 | TCTGATCCGGACTCTC | 59 | 1393 |
| 882494 | N/A | N/A | 14213 | 14228 | CAAAACCAGTACAGTC | 51 | 1394 |
| 882517 | N/A | N/A | 14622 | 14637 | CCAGAGCACACAGACG | 64 | 1395 |
| 882540 | N/A | N/A | 15021 | 15036 | GGGCAATGGAGTCTCG | 76 | 1396 |
| 882564 | N/A | N/A | 15538 | 15553 | GTCTCTCACGCAGTGC | 50 | 1397 |
| 882587 | N/A | N/A | 15838 | 15853 | GGCACAATTCTCTGAG | 57 | 1398 |
| 882610 | N/A | N/A | 16033 | 16048 | GATATCAAAGATCTCC | 43 | 1399 |
| 882634 | N/A | N/A | 16254 | 16269 | AAAGACAAGTGCCCAT | 76 | 1400 |
| 882657 | N/A | N/A | 16441 | 16456 | TGTCACTATGCCTGAA | 73 | 1401 |
| 882681 | N/A | N/A | 16726 | 16741 | ACGAAGATTCAAAAGG | 64 | 1402 |
| 882705 | N/A | N/A | 16962 | 16977 | CATCACCGAACACACC | 76 | 1403 |
| 882729 | N/A | N/A | 17289 | 17304 | CCTCAGACTGTGCTGC | 70 | 1404 |
| 882753 | N/A | N/A | 17567 | 17582 | ACCTACAAAATGCCTC | 58 | 1405 |
| 882777 | N/A | N/A | 17826 | 17841 | GGCAAATTAATGCTTC | 24 | 1406 |
| 882801 | N/A | N/A | 18096 | 18111 | TCTATGGGATTATATA | 74 | 1407 |
| 882824 | N/A | N/A | 18684 | 18699 | TTATGGACCACGCAGC | 69 | 1408 |
| 882848 | N/A | N/A | 19030 | 19045 | TTCTAGGTAATCTGTA | 62 | 1409 |
| 882871 | N/A | N/A | 19312 | 19327 | TTTCATATTTGGAGCC | 25 | 1410 |
| 882899 | N/A | N/A | 6633 | 6648 | AGTAGCTGGGCCCTCG | 38 | 1411 |

TABLE 21

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 31 | 195 |
| 668815 | 436 | 451 | 6915 | 6930 | CCTCAAAGTCATTGCT | 79 | 1412 |
| 881083 | 21 | 36 | 3760 | 3775 | TCCCAAGATCGAGCGG | 84 | 1413 |
| 881130 | 743 | 758 | 9233 | 9248 | TCACAAGCTGGGCCTT | 70 | 1414 |
| 881153 | 946 | 961 | 13499 | 13514 | CATGGGAGATCCGGCA | 59 | 1415 |
| 881177 | 1235 | 1250 | 17028 | 17043 | CCGTGGTGAGCAAACG | 68 | 1416 |
| 881201 | 1453 | 1468 | 19570 | 19585 | AGGAATGGCGGATAGA | 62 | 1417 |
| 881225 | 1793 | 1808 | 19910 | 19925 | CGCAATTCTCCTCAAC | 62 | 1418 |
| 881249 | 1960 | 1975 | 20077 | 20092 | AAATTAAAGAGCGCAT | 87 | 1419 |
| 881273 | 2054 | 2069 | 20171 | 20186 | GGCACAGACATACCTA | 52 | 1420 |
| 881297 | 2237 | 2252 | 20354 | 20369 | CACCAGGAAACCGCTG | 85 | 1421 |
| 881321 | 2399 | 2414 | 20516 | 20531 | CATTACTTAGACATTA | 81 | 1422 |
| 881345 | 2537 | 2552 | 20654 | 20669 | ATAGTTAAGTACTTGG | 52 | 1423 |
| 881369 | 2752 | 2767 | 20869 | 20884 | TATAATTGGCACGAGG | 59 | 1424 |
| 881393 | 2837 | 2852 | 20954 | 20969 | GTATACTTAAGCAAGT | 58 | 1425 |
| 881417 | 2921 | 2936 | 21038 | 21053 | ATCCTGTAGTATGAGA | 55 | 1426 |
| 881441 | 3069 | 3084 | 21186 | 21201 | CTTGATAAAGGCTGAA | 40 | 1427 |
| 881465 | 3372 | 3387 | 21489 | 21504 | GCTACAAAGAGCACTG | 37 | 1428 |
| 881489 | 3449 | 3464 | 21566 | 21581 | TCAAACCCTACTGGGT | 92 | 1429 |
| 881513 | 3532 | 3547 | 21649 | 21664 | TCTATAAGATGTATAC | 74 | 1430 |
| 881536 | 3726 | 3741 | 21843 | 21858 | AATGGAGCATCCGCTT | 107 | 1431 |
| 881560 | 3945 | 3960 | 22062 | 22077 | TGCTAGGATTCCTAAC | 74 | 1432 |
| 881584 | 4174 | 4189 | 22291 | 22306 | TACTGCTTGAGGTTTT | 50 | 1433 |
| 881603 | 4320 | 4335 | 22437 | 22452 | TTTTTAGTTCATACCC | 59 | 1434 |
| 881627 | 4451 | 4466 | 22568 | 22583 | GTATTTATGCCCTCGC | 47 | 1435 |
| 881651 | 4577 | 4592 | 22694 | 22709 | ATCTGAATTGTTACTA | 88 | 1436 |
| 881675 | 4732 | 4747 | 22849 | 22864 | CACCATTCAGACAGAT | 167 | 1437 |
| 881699 | 4918 | 4933 | 23035 | 23050 | CTACATTTCTTATGCA | 61 | 1438 |
| 881723 | 5180 | 5195 | 23297 | 23312 | TGTGAAGCATCCTTTC | 55 | 1439 |
| 881747 | 5218 | 5233 | 23335 | 23350 | TGTATACCAACGACAG | 42 | 1440 |
| 881771 | N/A | N/A | 18804 | 18819 | GATATTAGAGACTGTA | 49 | 1441 |
| 881795 | N/A | N/A | 22823 | 22838 | ACAGAGGACTTCGGGA | 136 | 1442 |
| 881816 | N/A | N/A | 4218 | 4233 | CTTAGGAACGAAGAGC | 93 | 1443 |
| 881840 | N/A | N/A | 4491 | 4506 | AAACGACAAGTGGCGC | 79 | 1444 |
| 881863 | N/A | N/A | 4860 | 4875 | GCGAAGGCTCCTACCC | 115 | 1445 |
| 881887 | N/A | N/A | 5369 | 5384 | CCCGAGGCGGAGACC | 94 | 1446 |
| 881910 | N/A | N/A | 5720 | 5735 | GACGGAGGCGGCAGAC | 143 | 1447 |

TABLE 21-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881932 | N/A | N/A | 5815 | 5830 | GAAAAGCAGCGAAAAG | 98 | 1448 |
| 881955 | N/A | N/A | 6278 | 6293 | GGTAGAGTGAGATGCG | 42 | 1449 |
| 881977 | N/A | N/A | 6663 | 6678 | GTTCTAGGGTCCTCCT | 50 | 1450 |
| 882001 | N/A | N/A | 7213 | 7228 | GGCATACAGTGTGATT | 75 | 1451 |
| 882025 | N/A | N/A | 7428 | 7443 | AGCTGACCATGTTACA | 119 | 1452 |
| 882049 | N/A | N/A | 7737 | 7752 | CTTAGAATGCATAACA | 74 | 1453 |
| 882073 | N/A | N/A | 8213 | 8228 | GGCACTACTTCCAAAA | 69 | 1454 |
| 882096 | N/A | N/A | 8452 | 8467 | CCGAAAAGACTGGAGT | 43 | 1455 |
| 882120 | N/A | N/A | 8702 8806 8962 | 8717 8821 8977 | AAGAAGCACTGGCATC | 77 | 1456 |
| 882143 | N/A | N/A | 9432 | 9447 | CCTGAGAGTAAACTTG | 82 | 1457 |
| 882166 | N/A | N/A | 9745 | 9760 | CTAATCCACAATCAGC | 55 | 1458 |
| 882189 | N/A | N/A | 10024 | 10039 | TTAAAGAGTGGTACAC | 94 | 1459 |
| 882213 | N/A | N/A | 10194 | 10209 | TTCCATAGAGCCAGAG | 63 | 1460 |
| 882237 | N/A | N/A | 10497 | 10512 | CAAAGCGGGTTCACAA | 84 | 1461 |
| 882261 | N/A | N/A | 10781 | 10796 | AGACAGAGAGTCCGAC | 93 | 1462 |
| 882285 | N/A | N/A | 11126 | 11141 | AACCACAAGCAGTGAT | 83 | 1463 |
| 882309 | N/A | N/A | 11409 | 11424 | GTATTACTCTTAGGCA | 36 | 1464 |
| 882333 | N/A | N/A | 11750 | 11765 | GCCACAACTCTCGCCT | 75 | 1465 |
| 882357 | N/A | N/A | 12004 | 12019 | GAAATCACGAGGTTGC | 38 | 1466 |
| 882381 | N/A | N/A | 12241 | 12256 | TCTAATAAATGTGCTC | 56 | 1467 |
| 882404 | N/A | N/A | 12698 | 12713 | CACATTAAAGGGTAAG | 101 | 1468 |
| 882427 | N/A | N/A | 13049 | 13064 | ACTATTAAGAACTTGC | 79 | 1469 |
| 882451 | N/A | N/A | 13293 | 13308 | GGGAACAAAAGGTTCC | 111 | 1470 |
| 882473 | N/A | N/A | 13957 | 13972 | ATCTGATCCGGACTCT | 91 | 1471 |
| 882495 | N/A | N/A | 14214 | 14229 | GCAAAACCAGTACAGT | 42 | 1472 |
| 882518 | N/A | N/A | 14630 | 14645 | CAACAGTGCCAGAGCA | 89 | 1473 |
| 882541 | N/A | N/A | 15070 | 15085 | TCCTATGGTCAGCCTC | 52 | 1474 |
| 882565 | N/A | N/A | 15590 | 15605 | CGCAAGTCTACAGCCC | 41 | 1475 |
| 882588 | N/A | N/A | 15839 | 15854 | TGGCACAATTCTCTGA | 87 | 1476 |
| 882611 | N/A | N/A | 16042 | 16057 | GAATAGGAAGATATCA | 94 | 1477 |
| 882635 | N/A | N/A | 16256 | 16271 | GGAAAGACAAGTGCCC | 46 | 1478 |
| 882658 | N/A | N/A | 16447 | 16462 | TCCCACTGTCACTATG | 85 | 1479 |
| 882682 | N/A | N/A | 16727 | 16742 | CACGAAGATTCAAAAG | 90 | 1480 |
| 882706 | N/A | N/A | 16971 | 16986 | AGAAACCCTCATCACC | 105 | 1481 |
| 882730 | N/A | N/A | 17330 | 17345 | CTTTGATGAGCAGATC | 88 | 1482 |

TABLE 21-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882754 | N/A | N/A | 17570 | 17585 | GAGACCTACAAAATGC | 89 | 1483 |
| 882778 | N/A | N/A | 17856 | 17871 | GTCTTAAGGGTTCAAG | 51 | 1484 |
| 882802 | N/A | N/A | 18097 | 18112 | GTCTATGGGATTATAT | 79 | 1485 |
| 882825 | N/A | N/A | 18685 | 18700 | TTTATGGACCACGCAG | 62 | 1486 |
| 882849 | N/A | N/A | 19033 | 19048 | GATTTCTAGGTAATCT | 69 | 1487 |
| 882872 | N/A | N/A | 19337 | 19352 | TTACATCCTAGAACAC | 97 | 1488 |

TABLE 22

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 35 | 195 |
| 669124 | 3537 | 3552 | 21654 | 21669 | TTGCATCTATAAGATG | 69 | 1489 |
| 881084 | 44 | 59 | 3783 | 3798 | TCGGAGCTGAGGGCAG | 82 | 1490 |
| 881107 | 448 | 463 | 6927 | 6942 | GCTCAACCAGTTCCTC | 62 | 1491 |
| 881131 | 754 | 769 | N/A | N/A | GGCAACCATTTTCACA | 117 | 1492 |
| 881154 | 949 | 964 | 13502 | 13517 | GTCCATGGGAGATCCG | 48 | 1493 |
| 881178 | 1245 | 1260 | 17038 | 17053 | CAGGGAGCGGCCGTGG | 83 | 1494 |
| 881202 | 1454 | 1469 | 19571 | 19586 | GAGGAATGGCGGATAG | 69 | 1495 |
| 881226 | 1794 | 1809 | 19911 | 19926 | CCGCAATTCTCCTCAA | 80 | 1496 |
| 881250 | 1961 | 1976 | 20078 | 20093 | CAAATTAAAGAGCGCA | 43 | 1497 |
| 881274 | 2055 | 2070 | 20172 | 20187 | TGGCACAGACATACCT | 62 | 1498 |
| 881298 | 2240 | 2255 | 20357 | 20372 | CCACACCAGGAAACCG | 86 | 1499 |
| 881322 | 2400 | 2415 | 20517 | 20532 | CCATTACTTAGACATT | 36 | 1500 |
| 881346 | 2538 | 2553 | 20655 | 20670 | GATAGTTAAGTACTTG | 51 | 1501 |
| 881370 | 2756 | 2771 | 20873 | 20888 | AAACTATAATTGGCAC | 70 | 1502 |
| 881394 | 2838 | 2853 | 20955 | 20970 | GGTATACTTAAGCAAG | 32 | 1503 |
| 881418 | 2927 | 2942 | 21044 | 21059 | GTAAATATCCTGTAGT | 67 | 1504 |
| 881442 | 3070 | 3085 | 21187 | 21202 | GCTTGATAAAGGCTGA | 27 | 1505 |
| 881466 | 3373 | 3388 | 21490 | 21505 | AGCTACAAAGAGCACT | 67 | 1506 |
| 881490 | 3450 | 3465 | 21567 | 21582 | GTCAAACCCTACTGGG | 69 | 1507 |
| 881537 | 3729 | 3744 | 21846 | 21861 | TGAAATGGAGCATCCG | 91 | 1508 |
| 881561 | 3951 | 3966 | 22068 | 22083 | GACAAGTGCTAGGATT | 39 | 1509 |
| 881585 | 4176 | 4191 | 22293 | 22308 | ATTACTGCTTGAGGTT | 38 | 1510 |
| 881604 | 4321 | 4336 | 22438 | 22453 | CTTTTTAGTTCATACC | 63 | 1511 |
| 881628 | 4452 | 4467 | 22569 | 22584 | TGTATTTATGCCCTCG | 56 | 1512 |

TABLE 22-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881652 | 4580 | 4595 | 22697 | 22712 | TGGATCTGAATTGTTA | 45 | 1513 |
| 881676 | 4735 | 4750 | 22852 | 22867 | ACGCACCATTCAGACA | 102 | 1514 |
| 881700 | 4972 | 4987 | 23089 | 23104 | GGAGGAGGGTTGGCCT | 99 | 1515 |
| 881724 | 5181 | 5196 | 23298 | 23313 | TTGTGAAGCATCCTTT | 37 | 1516 |
| 881748 | 5219 | 5234 | 23336 | 23351 | ATGTATACCAACGACA | 37 | 1517 |
| 881772 | N/A | N/A | 18805 | 18820 | TGATATTAGAGACTGT | 40 | 1518 |
| 881796 | N/A | N/A | 22825 | 22840 | CCACAGAGGACTTCGG | 73 | 1519 |
| 881817 | N/A | N/A | 4220 | 4235 | CCCTTAGGAACGAAGA | 106 | 1520 |
| 881841 | N/A | N/A | 4494 | 4509 | TGCAAACGACAAGTGG | 79 | 1521 |
| 881864 | N/A | N/A | 4861 | 4876 | CGCGAAGGCTCCTACC | 141 | 1522 |
| 881888 | N/A | N/A | 5370 | 5385 | TCCCGAGGCCGGAGAC | 127 | 1523 |
| 881911 | N/A | N/A | 5723 | 5738 | ACGGACGGAGGCGGCA | 89 | 1524 |
| 881956 | N/A | N/A | 6279 | 6294 | CGGTAGAGTGAGATGC | 46 | 1525 |
| 881978 | N/A | N/A | 6677 | 6692 | CATCGAACTCCTGAGT | 69 | 1526 |
| 882002 | N/A | N/A | 7218 | 7233 | ATTGAGGCATACAGTG | 70 | 1527 |
| 882026 | N/A | N/A | 7437 | 7452 | AAACACCTCAGCTGAC | 84 | 1528 |
| 882050 | N/A | N/A | 7784 | 7799 | GACCTAACTAAATGTC | 118 | 1529 |
| 882074 | N/A | N/A | 8218 | 8233 | GATAAGGCACTACTTC | 53 | 1530 |
| 882097 | N/A | N/A | 8463 | 8478 | CATTTTATCATCCGAA | 45 | 1531 |
| 882121 | N/A | N/A | 8753<br>8857<br>8909 | 8768<br>8872<br>8924 | GGAAGCACTGGCATTG | 51 | 1532 |
| 882144 | N/A | N/A | 9442 | 9457 | TAGCATGGATCCTGAG | 100 | 1533 |
| 882167 | N/A | N/A | 9746 | 9761 | TCTAATCCACAATCAG | 59 | 1534 |
| 882190 | N/A | N/A | 10025 | 10040 | ATTAAAGAGTGGTACA | 107 | 1535 |
| 882214 | N/A | N/A | 10198 | 10213 | CTAATTCCATAGAGCC | 20 | 1536 |
| 882238 | N/A | N/A | 10500 | 10515 | TCACAAAGCGGGTTCA | 77 | 1537 |
| 882262 | N/A | N/A | 10785 | 10800 | GTCTAGACAGAGAGTC | 98 | 1538 |
| 882286 | N/A | N/A | 11151 | 11166 | AGCCAGTGGCTGAAAC | 79 | 1539 |
| 882310 | N/A | N/A | 11411 | 11426 | GTGTATTACTCTTAGG | 14 | 1540 |
| 882334 | N/A | N/A | 11751 | 11766 | TGCCACAACTCTCGCC | 69 | 1541 |
| 882358 | N/A | N/A | 12005 | 12020 | AGAAATCACGAGGTTG | 36 | 1542 |
| 882382 | N/A | N/A | 12260 | 12275 | TCAATGGGAATCACAG | 60 | 1543 |
| 882405 | N/A | N/A | 12699 | 12714 | ACACATTAAGGGTAA | 89 | 1544 |
| 882428 | N/A | N/A | 13050 | 13065 | CACTATTAAGAACTTG | 67 | 1545 |
| 882452 | N/A | N/A | 13309 | 13324 | CCCACATGTCCCGTGG | 95 | 1546 |
| 882474 | N/A | N/A | 13995 | 14010 | TTGCAAGAGAACAGCC | 61 | 1547 |

TABLE 22-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882496 | N/A | N/A | 14215 | 14230 | TGCAAAACCAGTACAG | 72 | 1548 |
| 882519 | N/A | N/A | 14639 | 14654 | AGCACATGTCAACAGT | 69 | 1549 |
| 882542 | N/A | N/A | 15091 | 15106 | AACCAGCACAGTTCTC | 118 | 1550 |
| 882566 | N/A | N/A | 15591 | 15606 | GCGCAAGTCTACAGCC | 120 | 1551 |
| 882589 | N/A | N/A | 15854 | 15869 | ATCAGAATGGCGAGTT | 53 | 1552 |
| 882612 | N/A | N/A | 16046 | 16061 | ACCTGAATAGGAAGAT | 69 | 1553 |
| 882636 | N/A | N/A | 16258 | 16273 | TTGGAAAGACAAGTGC | 85 | 1554 |
| 882659 | N/A | N/A | 16464 | 16479 | AGCCATCGGCAGCTGA | 86 | 1555 |
| 882683 | N/A | N/A | 16733 | 16748 | TGGACCCACGAAGATT | 62 | 1556 |
| 882707 | N/A | N/A | 16972 | 16987 | CAGAAACCCTCATCAC | 96 | 1557 |
| 882731 | N/A | N/A | 17367 | 17382 | AAAGAGGCACCCTCCT | 138 | 1558 |
| 882755 | N/A | N/A | 17588 | 17603 | TGCTAGGACACAGCTG | 57 | 1559 |
| 882779 | N/A | N/A | 17862 | 17877 | TCAAAAGTCTTAAGGG | 93 | 1560 |
| 882803 | N/A | N/A | 18111 | 18126 | GAGAAAACTCCTGAGT | 95 | 1561 |
| 882826 | N/A | N/A | 18686 | 18701 | TTTTATGGACCACGCA | 69 | 1562 |
| 882850 | N/A | N/A | 19079 | 19094 | CACAACTGCAGTTTGA | 86 | 1563 |
| 882873 | N/A | N/A | 19343 | 19358 | CCAAAGTTACATCCTA | 61 | 1564 |
| 882897 | N/A | N/A | 5887 | 5902 | CCGCAGAGAGCTAGCA | 106 | 1565 |

TABLE 23

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 48 | 195 |
| 881085 | 49 | 64 | 3788 | 3803 | TGGACTCGGAGCTGAG | 76 | 1566 |
| 881108 | 462 | 477 | 6941 | 6956 | GTCCAGCTGGCTCCGC | 47 | 1567 |
| 881132 | 762 | 777 | N/A | N/A | TGTCACCTGGCAACCA | 91 | 1568 |
| 881155 | 987 | 1002 | 13540 | 13555 | GAACAGGACCTGGTCC | 75 | 1569 |
| 881203 | 1455 | 1470 | 19572 | 19587 | AGAGGAATGGCGGATA | 58 | 1570 |
| 881251 | 1962 | 1977 | 20079 | 20094 | ACAAATTAAAGAGCGC | 36 | 1571 |
| 881275 | 2078 | 2093 | 20195 | 20210 | TTACATCTTACTTCCC | 58 | 1572 |
| 881299 | 2306 | 2321 | 20423 | 20438 | ACTAACTGGCTTCCAG | 69 | 1573 |
| 881323 | 2401 | 2416 | 20518 | 20533 | ACCATTACTTAGACAT | 35 | 1574 |
| 881347 | 2539 | 2554 | 20656 | 20671 | AGATAGTTAAGTACTT | 89 | 1575 |
| 881371 | 2758 | 2773 | 20875 | 20890 | TCAAACTATAATTGGC | 26 | 1576 |
| 881395 | 2839 | 2854 | 20956 | 20971 | AGGTATACTTAAGCAA | 32 | 1577 |

TABLE 23-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881419 | 2929 | 2944 | 21046 | 21061 | TAGTAAATATCCTGTA | 58 | 1578 |
| 881443 | 3071 | 3086 | 21188 | 21203 | AGCTTGATAAAGGCTG | 64 | 1579 |
| 881467 | 3376 | 3391 | 21493 | 21508 | GTTAGCTACAAAGAGC | 59 | 1580 |
| 881491 | 3451 | 3466 | 21568 | 21583 | TGTCAAACCCTACTGG | 77 | 1581 |
| 881514 | 3549 | 3564 | 21666 | 21681 | CCCCAAAATACTTTGC | 0 | 1582 |
| 881538 | 3730 | 3745 | 21847 | 21862 | TTGAAATGGAGCATCC | 78 | 1583 |
| 881562 | 3952 | 3967 | 22069 | 22084 | AGACAAGTGCTAGGAT | 44 | 1584 |
| 881586 | 4186 | 4201 | 22303 | 22318 | GGAGATATTAATTACT | 50 | 1585 |
| 881605 | 4369 | 4384 | 22486 | 22501 | GCTCATTTCACTGTAG | 36 | 1586 |
| 881629 | 4453 | 4468 | 22570 | 22585 | CTGTATTTATGCCCTC | 40 | 1587 |
| 881653 | 4584 | 4599 | 22701 | 22716 | ACACTGGATCTGAATT | 54 | 1588 |
| 881677 | 4742 | 4757 | 22859 | 22874 | AGCCTTCACGCACCAT | 70 | 1589 |
| 881701 | 4976 | 4991 | 23093 | 23108 | CATTGGAGGAGGGTTG | 102 | 1590 |
| 881725 | 5183 | 5198 | 23300 | 23315 | GTTTGTGAAGCATCCT | 35 | 1591 |
| 881749 | 5220 | 5235 | 23337 | 23352 | GATGTATACCAACGAC | 32 | 1592 |
| 881773 | N/A | N/A | 18806 | 18821 | ATGATATTAGAGACTG | 26 | 1593 |
| 881797 | N/A | N/A | 3804 | 3819 | AGCCCTTACCTCGCCC | 75 | 1594 |
| 881818 | N/A | N/A | 4239 | 4254 | GGCCGCCGTGAGCTTG | 97 | 1595 |
| 881865 | N/A | N/A | 4862 | 4877 | CCGCGAAGGCTCCTAC | 86 | 1596 |
| 881912 | N/A | N/A | 5724 | 5739 | CACGGACGGAGGCGGC | 82 | 1597 |
| 881933 | N/A | N/A | 5894 | 5909 | GGAGTACCCGCAGAGA | 75 | 1598 |
| 881957 | N/A | N/A | 6282 | 6297 | AACCGGTAGAGTGAGA | 94 | 1599 |
| 881979 | N/A | N/A | 6682 | 6697 | CGCAGCATCGAACTCC | 67 | 1600 |
| 882003 | N/A | N/A | 7219 | 7234 | CATTGAGGCATACAGT | 45 | 1601 |
| 882027 | N/A | N/A | 7439 | 7454 | ATAAACACCTCAGCTG | 79 | 1602 |
| 882051 | N/A | N/A | 7791 | 7806 | AGGAACTGACCTAACT | 69 | 1603 |
| 882075 | N/A | N/A | 8219 | 8234 | TGATAAGGCACTACTT | 65 | 1604 |
| 882098 | N/A | N/A | 8464 | 8479 | GCATTTTATCATCCGA | 37 | 1605 |
| 882122 | N/A | N/A | 8754<br>8858<br>8910 | 8769<br>8873<br>8925 | AGGAAGCACTGGCATT | 41 | 1606 |
| 882145 | N/A | N/A | 9458 | 9473 | CACGAAGGGCAGTGCC | 83 | 1607 |
| 882168 | N/A | N/A | 9747 | 9762 | ATCTAATCCACAATCA | 70 | 1608 |
| 882191 | N/A | N/A | 10026 | 10041 | CATTAAAGAGTGGTAC | 103 | 1609 |
| 882215 | N/A | N/A | 10199 | 10214 | ACTAATTCCATAGAGC | 21 | 1610 |
| 882239 | N/A | N/A | 10519 | 10534 | TGACATGCTTTGTCCT | 41 | 1611 |
| 882263 | N/A | N/A | 10795 | 10810 | ATCAGATGATGTCTAG | 103 | 1612 |

TABLE 23-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882287 | N/A | N/A | 11160 | 11175 | CTCCATTCAAGCCAGT | 42 | 1613 |
| 882311 | N/A | N/A | 11446 | 11461 | GCAAGCTATATTAAAG | 29 | 1614 |
| 882335 | N/A | N/A | 11757 | 11772 | CAAAAGTGCCACAACT | 90 | 1615 |
| 882359 | N/A | N/A | 12008 | 12023 | ATCAGAAATCACGAGG | 29 | 1616 |
| 882383 | N/A | N/A | 12261 | 12276 | ATCAATGGGAATCACA | 10 | 1617 |
| 882406 | N/A | N/A | 12701 | 12716 | ACACACATTAAAGGGT | 57 | 1618 |
| 882429 | N/A | N/A | 13055 | 13070 | AGCATCACTATTAAGA | 28 | 1619 |
| 882453 | N/A | N/A | 13323 | 13338 | TGGAACTCTAGTGTCC | 98 | 1620 |
| 882475 | N/A | N/A | 14002 | 14017 | ACCAGAATTGCAAGAG | 40 | 1621 |
| 882497 | N/A | N/A | 14216 | 14231 | GTGCAAAACCAGTACA | 67 | 1622 |
| 882520 | N/A | N/A | 14640 | 14655 | GAGCACATGTCAACAG | 60 | 1623 |
| 882543 | N/A | N/A | 15112 | 15127 | TCACTTGCCGCCGCCT | 51 | 1624 |
| 882567 | N/A | N/A | 15600 | 15615 | GTTCTAGTCGCGCAAG | 73 | 1625 |
| 882590 | N/A | N/A | 15855 | 15870 | AATCAGAATGGCGAGT | 61 | 1626 |
| 882613 | N/A | N/A | 16052 | 16067 | GTGCAGACCTGAATAG | 86 | 1627 |
| 882637 | N/A | N/A | 16269 | 16284 | CTGGAACATTGTTGGA | 54 | 1628 |
| 882660 | N/A | N/A | 16501 | 16516 | CAGAAAATATGTAACG | 78 | 1629 |
| 882684 | N/A | N/A | 16736 | 16751 | CATTGGACCCACGAAG | 72 | 1630 |
| 882708 | N/A | N/A | 16975 | 16990 | GTTCAGAAACCCTCAT | 87 | 1631 |
| 882732 | N/A | N/A | 17368 | 17383 | GAAAGAGGCACCCTCC | 81 | 1632 |
| 882756 | N/A | N/A | 17597 | 17612 | TAAAGAGGTGCTAGG | 73 | 1633 |
| 882780 | N/A | N/A | 17889 | 17904 | GTATGTAGCAATGTGA | 79 | 1634 |
| 882804 | N/A | N/A | 18126 | 18141 | CTGGAGAGAACTCATG | 62 | 1635 |
| 882827 | N/A | N/A | 18687 | 18702 | ATTTTATGGACCACGC | 51 | 1636 |
| 882851 | N/A | N/A | 19080 | 19095 | CCACAACTGCAGTTTG | 77 | 1637 |
| 882874 | N/A | N/A | 19346 | 19361 | AGCCCAAAGTTACATC | 58 | 1638 |
| 882893 | N/A | N/A | 4508 | 4523 | CACTAAGTGGGCTCTG | 59 | 1639 |

TABLE 24

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 23 | 195 |
| 881086 | 149 | 164 | 5176 | 5191 | CCGAACTCTCCGCCTC | 64 | 1640 |
| 881133 | 774 | 789 | 10839 | 10854 | ATAAAAGGTTCCTGTC | 16 | 1641 |
| 881180 | 1256 | 1271 | 17049 | 17064 | TGGAATCTTGGCAGGG | 60 | 1642 |

TABLE 24-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881204 | 1457 | 1472 | 19574 | 19589 | ATAGAGGAATGGCGGA | 35 | 1643 |
| 881228 | 1828 | 1843 | 19945 | 19960 | AATCAGATGTCACTGA | 97 | 1644 |
| 881252 | 1973 | 1988 | 20090 | 20105 | CCTAATCTACAACAAA | 85 | 1645 |
| 881276 | 2124 | 2139 | 20241 | 20256 | CCTACATACATTAATA | 107 | 1646 |
| 881300 | 2307 | 2322 | 20424 | 20439 | TACTAACTGGCTTCCA | 72 | 1647 |
| 881324 | 2402 | 2417 | 20519 | 20534 | AACCATTACTTAGACA | 55 | 1648 |
| 881348 | 2540 | 2555 | 20657 | 20672 | CAGATAGTTAAGTACT | 56 | 1649 |
| 881372 | 2760 | 2775 | 20877 | 20892 | TGTCAAACTATAATTG | 85 | 1650 |
| 881396 | 2840 | 2855 | 20957 | 20972 | TAGGTATACTTAAGCA | 21 | 1651 |
| 881420 | 2933 | 2948 | 21050 | 21065 | GTAATAGTAAATATCC | 39 | 1652 |
| 881444 | 3076 | 3091 | 21193 | 21208 | CACTAAGCTTGATAAA | 111 | 1653 |
| 881468 | 3377 | 3392 | 21494 | 21509 | TGTTAGCTACAAAGAG | 53 | 1654 |
| 881492 | 3456 | 3471 | 21573 | 21588 | TGAAATGTCAAACCCT | 46 | 1655 |
| 881515 | 3559 | 3574 | 21676 | 21691 | GGATAATATACCCCAA | 36 | 1656 |
| 881539 | 3731 | 3746 | 21848 | 21863 | ATTGAAATGGAGCATC | 101 | 1657 |
| 881587 | 4187 | 4202 | 22304 | 22319 | AGGAGATATTAATTAC | 43 | 1658 |
| 881606 | 4378 | 4393 | 22495 | 22510 | GTAAGGGCTGCTCATT | 48 | 1659 |
| 881630 | 4459 | 4474 | 22576 | 22591 | GGCTAGCTGTATTTAT | 63 | 1660 |
| 881654 | 4586 | 4601 | 22703 | 22718 | TTACACTGGATCTGAA | 62 | 1661 |
| 881678 | 4755 | 4770 | 22872 | 22887 | TGTAAGGTCTGAGAGC | 75 | 1662 |
| 881702 | 4978 | 4993 | 23095 | 23110 | TCCATTGGAGGAGGGT | 67 | 1663 |
| 881726 | 5184 | 5199 | 23301 | 23316 | AGTTTGTGAAGCATCC | 31 | 1664 |
| 881750 | 5222 | 5237 | 23339 | 23354 | ATGATGTATACCAACG | 14 | 1665 |
| 881774 | N/A | N/A | 18807 | 18822 | CATGATATTAGAGACT | 44 | 1666 |
| 881798 | N/A | N/A | 3865 | 3880 | CTGGTTCGCGCTCCGG | 93 | 1667 |
| 881819 | N/A | N/A | 4244 | 4259 | CCGGAGGCCGCCGTGA | 87 | 1668 |
| 881842 | N/A | N/A | 4510 | 4525 | CGCACTAAGTGGGCTC | 86 | 1669 |
| 881866 | N/A | N/A | 4892 | 4907 | GCACAGCCGTCCGCCT | 84 | 1670 |
| 881890 | N/A | N/A | 5492 | 5507 | CGCCACCTGATGCCTC | 70 | 1671 |
| 881913 | N/A | N/A | 5726 | 5741 | CCCACGGACGGAGGCG | 109 | 1672 |
| 881934 | N/A | N/A | 5896 | 5911 | TGGGAGTACCCGCAGA | 74 | 1673 |
| 881958 | N/A | N/A | 6284 | 6299 | ATAACCGGTAGAGTGA | 50 | 1674 |
| 881980 | N/A | N/A | 6683 | 6698 | CCGCAGCATCGAACTC | 58 | 1675 |
| 882028 | N/A | N/A | 7481 | 7496 | GGTCAGAATCTTGAAA | 91 | 1676 |
| 882052 | N/A | N/A | 7795 | 7810 | AAACAGGAACTGACCT | 80 | 1677 |
| 882076 | N/A | N/A | 8220 | 8235 | ATGATAAGGCACTACT | 87 | 1678 |

TABLE 24-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882099 | N/A | N/A | 8465 | 8480 | AGCATTTTATCATCCG | 19 | 1679 |
| 882123 | N/A | N/A | 8781 | 8796 | TTAAAGGAGTGCAGGA | 84 | 1680 |
| 882146 | N/A | N/A | 9460 | 9475 | CCCACGAAGGGCAGTG | 65 | 1681 |
| 882169 | N/A | N/A | 9751 | 9766 | CCACATCTAATCCACA | 33 | 1682 |
| 882192 | N/A | N/A | 10049 | 10064 | GTGAACATGCCACTCA | 38 | 1683 |
| 882216 | N/A | N/A | 10200 | 10215 | TACTAATTCCATAGAG | 74 | 1684 |
| 882240 | N/A | N/A | 10520 | 10535 | ATGACATGCTTTGTCC | 54 | 1685 |
| 882264 | N/A | N/A | 10939 | 10954 | AGCAAACCCTGCACTC | 92 | 1686 |
| 882288 | N/A | N/A | 11215 | 11230 | GGTAAAGGCACATTCC | 53 | 1687 |
| 882312 | N/A | N/A | 11448 | 11463 | TTGCAAGCTATATTAA | 66 | 1688 |
| 882336 | N/A | N/A | 11790 | 11805 | TGGTAGGTCAAACTCC | 113 | 1689 |
| 882360 | N/A | N/A | 12009 | 12024 | CATCAGAAATCACGAG | 45 | 1690 |
| 882384 | N/A | N/A | 12283 | 12298 | GGTAACTGTATGGAAC | 24 | 1691 |
| 882407 | N/A | N/A | 12757 | 12772 | GAATTAGGTGCTTAAT | 41 | 1692 |
| 882430 | N/A | N/A | 13060 | 13075 | TATAGAGCATCACTAT | 59 | 1693 |
| 882454 | N/A | N/A | 13324 | 13339 | GTGGAACTCTAGTGTC | 88 | 1694 |
| 882476 | N/A | N/A | 14021 | 14036 | TAAGAGGCGACTGCTG | 145 | 1695 |
| 882498 | N/A | N/A | 14233 | 14248 | CTCCTATAACTTCTCC | 67 | 1696 |
| 882521 | N/A | N/A | 14643 | 14658 | TACGAGCACATGTCAA | 64 | 1697 |
| 882544 | N/A | N/A | 15146 | 15161 | TAGAATGAGAGGTGTC | 71 | 1698 |
| 882568 | N/A | N/A | 15609 | 15624 | TAATAGTAAGTTCTAG | 100 | 1699 |
| 882591 | N/A | N/A | 15860 | 15875 | AGGCTAATCAGAATGG | 58 | 1700 |
| 882614 | N/A | N/A | 16099 | 16114 | TCAGATACACACCCTC | 63 | 1701 |
| 882638 | N/A | N/A | 16276 | 16291 | AAACGGACTGGAACAT | 93 | 1702 |
| 882661 | N/A | N/A | 16516 | 16531 | GTAACTCAGGCACCAC | 53 | 1703 |
| 882685 | N/A | N/A | 16758 | 16773 | GCTAAAGAACACTGCT | 97 | 1704 |
| 882709 | N/A | N/A | 16981 | 16996 | GACCATGTTCAGAAAC | 4 | 1705 |
| 882733 | N/A | N/A | 17369 | 17384 | GGAAAGAGGCACCCTC | 72 | 1706 |
| 882757 | N/A | N/A | 17640 | 17655 | TATCATATGCCCAATA | 68 | 1707 |
| 882781 | N/A | N/A | 17894 | 17909 | TGCAAGTATGTAGCAA | 97 | 1708 |
| 882805 | N/A | N/A | 18131 | 18146 | AATCACTGGAGAGAAC | 71 | 1709 |
| 882828 | N/A | N/A | 18688 | 18703 | CATTTTATGGACCACG | 38 | 1710 |
| 882852 | N/A | N/A | 19099 | 19114 | GGCCAATGATTTTGTT | 94 | 1711 |
| 882875 | N/A | N/A | 19350 | 19365 | GTAAAGCCCAAAGTTA | 73 | 1712 |

Example 6: Effect of 3-10-3 cEt Gapmers with Phosphorothioate Internucleoside Linkages on Human IRF4 In Vitro, Single Dose Modified oligonucleotides complementary to a human IRF4 nucleic acid were designed and tested for their effect on IRF4 mRNA in vitro.

Cultured SK-MEL-28 cells at a density of 20,000 cells per well were transfected using electroporation with 4,000 nM concentration of modified oligonucleotide or no modified oligonucleotide for untreated controls. After approximately 24 hours, RNA was isolated from the cells and IRF4 mRNA levels were measured by quantitative real-time PCR. Human primer probe set RTS3114 (described hereinabove in Example 1) was used to measure mRNA levels. IRF4 mRNA levels were adjusted according to total RNA content, as measured by RIBOGREEN®. Results are presented in the table below as percent control of the amount of IRF4 mRNA, relative to untreated control (UTC) cells.

The modified oligonucleotides in Tables 25 through 36 are 3-10-3 cEt gapmers. The gapmers are 16 nucleobases in length, wherein the central gap segment comprises ten 2'-deoxynucleosides and is flanked by wing segments on both the 5' end and on the 3' end comprising three cEt nucleosides. The sugar motif for the gapmers is (from 5' to 3'): kkkddddddddddkkk; wherein 'd' represents a 2'-deoxyribose sugar and 'k' represents a cEt modified sugar. Each internucleoside linkage is a phosphorothioate internucleoside linkage and each cytosine residue is a 5-methylcytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Tables 25 through 36 below is complementary to human IRF4 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to human IRF4 reduced the amount of human IRF4 mRNA.

TABLE 25

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 44 | 195 |
| 881087 | 151 | 166 | 5178 | 5193 | TGCCGAACTCTCCGCC | 57 | 1713 |
| 881110 | 482 | 497 | 6961 | 6976 | ACTTTGTACGGGTCTG | 61 | 1714 |
| 881134 | 778 | 793 | 10843 | 10858 | AAGCATAAAAGGTTCC | 72 | 1715 |
| 881157 | 1059 | 1074 | 13612 | 13627 | GACCACGCCCCTCTCC | 45 | 1716 |
| 881181 | 1263 | 1278 | 17056 | 17071 | AGTCACCTGGAATCTT | 53 | 1717 |
| 881205 | 1458 | 1473 | 19575 | 19590 | AATAGAGGAATGGCGG | 47 | 1718 |
| 881229 | 1831 | 1846 | 19948 | 19963 | GCCAATCAGATGTCAC | 54 | 1719 |
| 881253 | 1974 | 1989 | 20091 | 20106 | ACCTAATCTACAACAA | 83 | 1720 |
| 881277 | 2128 | 2143 | 20245 | 20260 | AGCTCCTACATACATT | 56 | 1721 |
| 881301 | 2309 | 2324 | 20426 | 20441 | TTTACTAACTGGCTTC | 55 | 1722 |
| 881325 | 2432 | 2447 | 20549 | 20564 | GGTCAAAAAGATGCAG | 49 | 1723 |
| 881349 | 2541 | 2556 | 20658 | 20673 | ACAGATAGTTAAGTAC | 65 | 1724 |
| 881373 | 2770 | 2785 | 20887 | 20902 | TTTAAGGCCCTGTCAA | 117 | 1725 |
| 881397 | 2842 | 2857 | 20959 | 20974 | GATAGGTATACTTAAG | 49 | 1726 |
| 881421 | 2938 | 2953 | 21055 | 21070 | TGGGAGTAATAGTAAA | 84 | 1727 |
| 881445 | 3077 | 3092 | 21194 | 21209 | TCACTAAGCTTGATAA | 63 | 1728 |
| 881469 | 3383 | 3398 | 21500 | 21515 | CTTCACTGTTAGCTAC | 49 | 1729 |
| 881493 | 3468 | 3483 | 21585 | 21600 | TTGCATGGCTAATGAA | 58 | 1730 |
| 881516 | 3560 | 3575 | 21677 | 21692 | AGGATAATATACCCCA | 26 | 1731 |
| 881540 | 3733 | 3748 | 21850 | 21865 | CAATTGAAATGGAGCA | 74 | 1732 |
| 881564 | 3956 | 3971 | 22073 | 22088 | CCTGAGACAAGTGCTA | 57 | 1733 |
| 881588 | 4200 | 4215 | 22317 | 22332 | TCTATAGTGTTCCAGG | 20 | 1734 |

TABLE 25-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881607 | 4380 | 4395 | 22497 | 22512 | CTGTAAGGGCTGCTCA | 44 | 1735 |
| 881631 | 4482 | 4497 | 22599 | 22614 | TCCCAGAGTTGTTCCA | 74 | 1736 |
| 881655 | 4587 | 4602 | 22704 | 22719 | TTTACACTGGATCTGA | 75 | 1737 |
| 881679 | 4756 | 4771 | 22873 | 22888 | GTGTAAGGTCTGAGAG | 84 | 1738 |
| 881703 | 4979 | 4994 | 23096 | 23111 | TTCCATTGGAGGAGGG | 72 | 1739 |
| 881727 | 5185 | 5200 | 23302 | 23317 | CAGTTTGTGAAGCATC | 22 | 1740 |
| 881751 | 5223 | 5238 | 23340 | 23355 | CATGATGTATACCAAC | 49 | 1741 |
| 881775 | N/A | N/A | 18808 | 18823 | TCATGATATTAGAGAC | 65 | 1742 |
| 881799 | N/A | N/A | 3874 | 3889 | GTCGAACCTCTGGTTC | 110 | 1743 |
| 881820 | N/A | N/A | 4246 | 4261 | CGCCGGAGGCCGCCGT | 97 | 1744 |
| 881843 | N/A | N/A | 4511 | 4526 | GCGCACTAAGTGGGCT | 110 | 1745 |
| 881867 | N/A | N/A | 4893 | 4908 | GGCACAGCCGTCCGCC | 89 | 1746 |
| 881891 | N/A | N/A | 5535 | 5550 | CTGAGAGCCGAGGCCT | 117 | 1747 |
| 881914 | N/A | N/A | 5727 | 5742 | ACCCACGGACGGAGGC | 109 | 1748 |
| 881935 | N/A | N/A | 5903 | 5918 | ACAGAGGTGGGAGTAC | 174 | 1749 |
| 881959 | N/A | N/A | 6285 | 6300 | TATAACCGGTAGAGTG | 79 | 1750 |
| 881981 | N/A | N/A | 6697 | 6712 | ACGATGATAGCTCACC | 92 | 1751 |
| 882005 | N/A | N/A | 7221 | 7236 | TACATTGAGGCATACA | 59 | 1752 |
| 882029 | N/A | N/A | 7547 | 7562 | CCCAAGTGAGGTCACC | 80 | 1753 |
| 882053 | N/A | N/A | 7837 | 7852 | GGCTCCTACATGTTTG | 146 | 1754 |
| 882077 | N/A | N/A | 8222 | 8237 | ACATGATAAGGCACTA | 39 | 1755 |
| 882100 | N/A | N/A | 8470 | 8485 | GCCGAAGCATTTTATC | 71 | 1756 |
| 882124 | N/A | N/A | 8782 | 8797 | GTTAAAGGAGTGCAGG | 114 | 1757 |
| 882147 | N/A | N/A | 9461 | 9476 | TCCCACGAAGGGCAGT | 94 | 1758 |
| 882170 | N/A | N/A | 9788 | 9803 | TCATTTTGATGTCTGG | 37 | 1759 |
| 882193 | N/A | N/A | 10078 | 10093 | GCCAATGCAACTGAAT | 64 | 1760 |
| 882217 | N/A | N/A | 10202 | 10217 | GTTACTAATTCCATAG | 51 | 1761 |
| 882241 | N/A | N/A | 10525 | 10540 | GACAGATGACATGCTT | 91 | 1762 |
| 882265 | N/A | N/A | 10940 | 10955 | GAGCAAACCCTGCACT | 116 | 1763 |
| 882289 | N/A | N/A | 11216 | 11231 | AGGTAAAGGCACATTC | 81 | 1764 |
| 882313 | N/A | N/A | 11469 | 11484 | TCAGATTGAATCCATA | 36 | 1765 |
| 882337 | N/A | N/A | 11793 | 11808 | AGCTGGTAGGTCAAAC | 105 | 1766 |
| 882361 | N/A | N/A | 12050 | 12065 | TTCGAGGTGATTCTCG | 95 | 1767 |
| 882385 | N/A | N/A | 12284 | 12299 | TGGTAACTGTATGGAA | 52 | 1768 |
| 882408 | N/A | N/A | 12758 | 12773 | AGAATTAGGTGCTTAA | 39 | 1769 |
| 882431 | N/A | N/A | 13064 | 13079 | CTATTATAGAGCATCA | 45 | 1770 |
| 882455 | N/A | N/A | 13356 | 13371 | GGCCAACGACTCCACA | 77 | 1771 |

TABLE 25-continued

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882477 | N/A | N/A | 14022 | 14037 | TTAAGAGGCGACTGCT | 88 | 1772 |
| 882499 | N/A | N/A | 14244 | 14259 | CTTATAGCACTCTCCT | 67 | 1773 |
| 882522 | N/A | N/A | 14645 | 14660 | AGTACGAGCACATGTC | 66 | 1774 |
| 882545 | N/A | N/A | 15191 | 15206 | AAGGATGGGACCGCCC | 61 | 1775 |
| 882569 | N/A | N/A | 15613 | 15628 | AGATTAATAGTAAGTT | 96 | 1776 |
| 882592 | N/A | N/A | 15864 | 15879 | ACACAGGCTAATCAGA | 93 | 1777 |
| 882615 | N/A | N/A | 16100 | 16115 | ATCAGATACACACCCT | 108 | 1778 |
| 882639 | N/A | N/A | 16278 | 16293 | CAAAACGGACTGGAAC | 84 | 1779 |
| 882662 | N/A | N/A | 16517 | 16532 | CGTAACTCAGGCACCA | 70 | 1780 |
| 882686 | N/A | N/A | 16762 | 16777 | GACAGCTAAAGAACAC | 81 | 1781 |
| 882710 | N/A | N/A | 16993 | 17008 | CCACAAGAAAGAGACC | 109 | 1782 |
| 882734 | N/A | N/A | 17400 | 17415 | CGACAACTTTCCTGAA | 79 | 1783 |
| 882758 | N/A | N/A | 17644 | 17659 | CAAATATCATATGCCC | 31 | 1784 |
| 882782 | N/A | N/A | 17904 | 17919 | TAATAATGCTTGCAAG | 88 | 1785 |
| 882806 | N/A | N/A | 18135 | 18150 | AGTCAATCACTGGAGA | 40 | 1786 |
| 882829 | N/A | N/A | 18691 | 18706 | ATTCATTTTATGGACC | 58 | 1787 |
| 882853 | N/A | N/A | 19108 | 19123 | GGTAATTTAGGCCAAT | 65 | 1788 |
| 882876 | N/A | N/A | 19366 | 19381 | CTAAGGAGACAGTAAC | 71 | 1789 |

TABLE 26

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 42 | 195 |
| 881088 | 157 | 172 | 5184 | 5199 | CGCTCATGCCGAACTC | 89 | 1790 |
| 881111 | 485 | 500 | 6964 | 6979 | TACACTTTGTACGGGT | 72 | 1791 |
| 881135 | 782 | 797 | 10847 | 10862 | GCACAAGCATAAAAGG | 84 | 1792 |
| 881158 | 1062 | 1077 | 13615 | 13630 | GAGGACCACGCCCCTC | 103 | 1793 |
| 881182 | 1269 | 1284 | 17062 | 17077 | GCATAGAGTCACCTGG | 61 | 1794 |
| 881206 | 1459 | 1474 | 19576 | 19591 | GAATAGAGGAATGGCG | 61 | 1795 |
| 881230 | 1832 | 1847 | 19949 | 19964 | TGCCAATCAGATGTCA | 78 | 1796 |
| 881254 | 1975 | 1990 | 20092 | 20107 | GACCTAATCTACAACA | 67 | 1797 |
| 881278 | 2150 | 2165 | 20267 | 20282 | AAGTGTCTTCCACAAG | 46 | 1798 |
| 881302 | 2310 | 2325 | 20427 | 20442 | GTTTACTAACTGGCTT | 73 | 1799 |
| 881326 | 2443 | 2458 | 20560 | 20575 | TAAAGAATGAGGGTCA | 55 | 1800 |

TABLE 26-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881350 | 2543 | 2558 | 20660 | 20675 | GAACAGATAGTTAAGT | 83 | 1801 |
| 881374 | 2771 | 2786 | 20888 | 20903 | TTTTAAGGCCCTGTCA | 82 | 1802 |
| 881398 | 2843 | 2858 | 20960 | 20975 | TGATAGGTATACTTAA | 72 | 1803 |
| 881422 | 2957 | 2972 | 21074 | 21089 | CGCAATCTTCTGCTGA | 36 | 1804 |
| 881446 | 3079 | 3094 | 21196 | 21211 | GCTCACTAAGCTTGAT | 44 | 1805 |
| 881470 | 3390 | 3405 | 21507 | 21522 | GGTAAATCTTCACTGT | 35 | 1806 |
| 881494 | 3475 | 3490 | 21592 | 21607 | ATCCATGTTGCATGGC | 39 | 1807 |
| 881517 | 3561 | 3576 | 21678 | 21693 | TAGGATAATATACCCC | 26 | 1808 |
| 881541 | 3734 | 3749 | 21851 | 21866 | GCAATTGAAATGGAGC | 76 | 1809 |
| 881565 | 3979 | 3994 | 22096 | 22111 | AGGAAGCCGTTCCTTT | 58 | 1810 |
| 881589 | 4201 | 4216 | 22318 | 22333 | CTCTATAGTGTTCCAG | 34 | 1811 |
| 881608 | 4381 | 4396 | 22498 | 22513 | ACTGTAAGGGCTGCTC | 31 | 1812 |
| 881632 | 4495 | 4510 | 22612 | 22627 | GAGTACCCAAGACTCC | 75 | 1813 |
| 881656 | 4588 | 4603 | 22705 | 22720 | GTTTACACTGGATCTG | 39 | 1814 |
| 881680 | 4765 | 4780 | 22882 | 22897 | CAAAATGGTGTGTAAG | 75 | 1815 |
| 881704 | 4983 | 4998 | 23100 | 23115 | GAATTTCCATTGGAGG | 57 | 1816 |
| 881728 | 5187 | 5202 | 23304 | 23319 | CTCAGTTTGTGAAGCA | 15 | 1817 |
| 881752 | 5224 | 5239 | 23341 | 23356 | TCATGATGTATACCAA | 35 | 1818 |
| 881776 | N/A | N/A | 18810 | 18825 | AATCATGATATTAGAG | 69 | 1819 |
| 881800 | N/A | N/A | 3880 | 3895 | CTGGAGGTCGAACCTC | 98 | 1820 |
| 881821 | N/A | N/A | 4257 | 4272 | GGTGAGCACCGCGCCG | 108 | 1821 |
| 881844 | N/A | N/A | 4522 | 4537 | GCCCAGCTAGCGCGCA | 71 | 1822 |
| 881868 | N/A | N/A | 4909 | 4924 | GCGCATCCCCTGGGCG | 104 | 1823 |
| 881892 | N/A | N/A | 5538 | 5553 | CCGCTGAGAGCCGAGG | 104 | 1824 |
| 881915 | N/A | N/A | 5730 | 5745 | GGGACCCACGGACGGA | 91 | 1825 |
| 881936 | N/A | N/A | 5972 | 5987 | CTCTAGACAGAGGCCC | 80 | 1826 |
| 881960 | N/A | N/A | 6286 | 6301 | TTATAACCGGTAGAGT | 62 | 1827 |
| 881982 | N/A | N/A | 6761 | 6776 | GGTTTATTAGCTTTCT | 101 | 1828 |
| 882006 | N/A | N/A | 7226 | 7241 | CCATATACATTGAGGC | 56 | 1829 |
| 882030 | N/A | N/A | 7574 | 7589 | ATAAAGGACCCCGCCA | 82 | 1830 |
| 882054 | N/A | N/A | 8019 | 8034 | GGCAAGTTCTGCTGTC | 42 | 1831 |
| 882078 | N/A | N/A | 8226 | 8241 | TTTCACATGATAAGGC | 57 | 1832 |
| 882101 | N/A | N/A | 8471 | 8486 | AGCCGAAGCATTTTAT | 56 | 1833 |
| 882125 | N/A | N/A | 9093 | 9108 | CTAAGGAGTGCAGGA | 94 | 1834 |
| 882148 | N/A | N/A | 9467 | 9482 | ATAAGATCCCACGAAG | 142 | 1835 |

TABLE 26-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882171 | N/A | N/A | 9816 | 9831 | AGCTAATGAGAGCTTC | 83 | 1836 |
| 882194 | N/A | N/A | 10086 | 10101 | CTTGAAAAGCCAATGC | 42 | 1837 |
| 882218 | N/A | N/A | 10203 | 10218 | GGTTACTAATTCCATA | 44 | 1838 |
| 882242 | N/A | N/A | 10526 | 10541 | AGACAGATGACATGCT | 50 | 1839 |
| 882266 | N/A | N/A | 11013 | 11028 | TCTAAAGTCCCATCGA | 69 | 1840 |
| 882290 | N/A | N/A | 11220 | 11235 | GTAAAGGTAAAGGCAC | 58 | 1841 |
| 882314 | N/A | N/A | 11528 | 11543 | GGTAAGATCTCCATGG | 55 | 1842 |
| 882338 | N/A | N/A | 11798 | 11813 | GAAAGAGCTGGTAGGT | 100 | 1843 |
| 882362 | N/A | N/A | 12054 | 12069 | GCCATTCGAGGTGATT | 44 | 1844 |
| 882386 | N/A | N/A | 12355 | 12370 | ACCAAGCTGGGTTTGC | 47 | 1845 |
| 882409 | N/A | N/A | 12760 | 12775 | ATAGAATTAGGTGCTT | 36 | 1846 |
| 882432 | N/A | N/A | 13065 | 13080 | CCTATTATAGAGCATC | 32 | 1847 |
| 882456 | N/A | N/A | 13361 | 13376 | CTCGAGGCCAACGACT | 99 | 1848 |
| 882478 | N/A | N/A | 14025 | 14040 | GTTTTAAGAGGCGACT | 67 | 1849 |
| 882500 | N/A | N/A | 14246 | 14261 | AACTTATAGCACTCTC | 72 | 1850 |
| 882523 | N/A | N/A | 14648 | 14663 | AGAAGTACGAGCACAT | 56 | 1851 |
| 882546 | N/A | N/A | 15192 | 15207 | GAAGGATGGGACCGCC | 59 | 1852 |
| 882570 | N/A | N/A | 15617 | 15632 | TCACAGATTAATAGTA | 77 | 1853 |
| 882593 | N/A | N/A | 15867 | 15882 | CCTACACAGGCTAATC | 87 | 1854 |
| 882616 | N/A | N/A | 16101 | 16116 | TATCAGATACACACCC | 81 | 1855 |
| 882640 | N/A | N/A | 16279 | 16294 | ACAAAACGGACTGGAA | 86 | 1856 |
| 882663 | N/A | N/A | 16535 | 16550 | TGCTACTGCGGACATC | 57 | 1857 |
| 882687 | N/A | N/A | 16763 | 16778 | CGACAGCTAAAGAACA | 63 | 1858 |
| 882711 | N/A | N/A | 17000 | 17015 | TAGAAGCCCACAAGAA | 99 | 1859 |
| 882735 | N/A | N/A | 17402 | 17417 | TACGACAACTTTCCTG | 59 | 1860 |
| 882759 | N/A | N/A | 17662 | 17677 | GAAAGATTCAGCCTCT | 55 | 1861 |
| 882783 | N/A | N/A | 17906 | 17921 | GTTAATAATGCTTGCA | 98 | 1862 |
| 882807 | N/A | N/A | 18141 | 18156 | TTATTAAGTCAATCAC | 101 | 1863 |
| 882830 | N/A | N/A | 18714 | 18729 | CTCATAGGTGTACACG | 41 | 1864 |
| 882854 | N/A | N/A | 19114 | 19129 | CTGCAGGGTAATTTAG | 66 | 1865 |
| 882877 | N/A | N/A | 19379 | 19394 | CAGCACTCAGATTCTA | 88 | 1866 |

TABLE 27

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 41 | 195 |
| 668855 | 783 | 798 | 10848 | 10863 | GGCACAAGCATAAAAG | 99 | 1867 |
| 690520 | 4222 | 4237 | 22339 | 22354 | AAATGAGTCGGTCACT | 45 | 1868 |
| 881089 | 165 | 180 | 5192 | 5207 | GCTCACCGCGCTCATG | 52 | 1869 |
| 881112 | 486 | 501 | 6965 | 6980 | GTACACTTTGTACGGG | 36 | 1870 |
| 881159 | 1067 | 1082 | 13620 | 13635 | ATCCAGAGGACCACGC | 81 | 1871 |
| 881183 | 1270 | 1285 | 17063 | 17078 | AGCATAGAGTCACCTG | 37 | 1872 |
| 881207 | 1460 | 1475 | 19577 | 19592 | TGAATAGAGGAATGGC | 79 | 1873 |
| 881231 | 1844 | 1859 | 19961 | 19976 | AATAAGCTCATCTGCC | 64 | 1874 |
| 881255 | 1978 | 1993 | 20095 | 20110 | CAAGACCTAATCTACA | 88 | 1875 |
| 881279 | 2151 | 2166 | 20268 | 20283 | CAAGTGTCTTCCACAA | 35 | 1876 |
| 881303 | 2311 | 2326 | 20428 | 20443 | AGTTTACTAACTGGCT | 37 | 1877 |
| 881327 | 2444 | 2459 | 20561 | 20576 | CTAAAGAATGAGGGTC | 38 | 1878 |
| 881351 | 2545 | 2560 | 20662 | 20677 | GGGAACAGATAGTTAA | 74 | 1879 |
| 881375 | 2773 | 2788 | 20890 | 20905 | AATTTTAAGGCCCTGT | 76 | 1880 |
| 881399 | 2844 | 2859 | 20961 | 20976 | GTGATAGGTATACTTA | 35 | 1881 |
| 881423 | 2958 | 2973 | 21075 | 21090 | ACGCAATCTTCTGCTG | 48 | 1882 |
| 881447 | 3086 | 3101 | 21203 | 21218 | GCTCACTGCTCACTAA | 67 | 1883 |
| 881471 | 3391 | 3406 | 21508 | 21523 | AGGTAAATCTTCACTG | 46 | 1884 |
| 881495 | 3479 | 3494 | 21596 | 21611 | ACATATCCATGTTGCA | 21 | 1885 |
| 881518 | 3562 | 3577 | 21679 | 21694 | TTAGGATAATATACCC | 48 | 1886 |
| 881542 | 3785 | 3800 | 21902 | 21917 | ACTGTTAAAGCAGCAT | 29 | 1887 |
| 881566 | 3980 | 3995 | 22097 | 22112 | GAGGAAGCCGTTCCTT | 49 | 1888 |
| 881609 | 4383 | 4398 | 22500 | 22515 | ATACTGTAAGGGCTGC | 46 | 1889 |
| 881633 | 4504 | 4519 | 22621 | 22636 | AAGAGGTGCGAGTACC | 66 | 1890 |
| 881657 | 4590 | 4605 | 22707 | 22722 | AAGTTTACACTGGATC | 42 | 1891 |
| 881681 | 4786 | 4801 | 22903 | 22918 | GGGCATGTAAAACATA | 77 | 1892 |
| 881705 | 4985 | 5000 | 23102 | 23117 | GGGAATTTCCATTGGA | 56 | 1893 |
| 881729 | 5188 | 5203 | 23305 | 23320 | CCTCAGTTTGTGAAGC | 31 | 1894 |
| 881753 | 5226 | 5241 | 23343 | 23358 | ATTCATGATGTATACC | 38 | 1895 |
| 881777 | N/A | N/A | 18811 | 18826 | CAATCATGATATTAGA | 62 | 1896 |
| 881801 | N/A | N/A | 3897 | 3912 | GGGTACCCTGCGCTGC | 56 | 1897 |
| 881822 | N/A | N/A | 4292 | 4307 | CCAAATGTGGAGCTCC | 77 | 1898 |
| 881845 | N/A | N/A | 4542 | 4557 | CGAATAGGACCCCTAT | 91 | 1899 |
| 881869 | N/A | N/A | 4916 | 4931 | GGCCCGGGCGCATCCC | 95 | 1900 |
| 881893 | N/A | N/A | 5548 | 5563 | CCCCGCGGTCCCGCTG | 59 | 1901 |
| 881916 | N/A | N/A | 5749 | 5764 | ACGCACGGAGAGGGCG | 99 | 1902 |

TABLE 27-continued

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881937 | N/A | N/A | 5974 | 5989 | AGCTCTAGACAGAGGC | 65 | 1903 |
| 881961 | N/A | N/A | 6287 | 6302 | TTTATAACCGGTAGAG | 46 | 1904 |
| 881983 | N/A | N/A | 6783 | 6798 | CGAAAAGTCAAAATAC | 100 | 1905 |
| 882007 | N/A | N/A | 7228 | 7243 | CCCCATATACATTGAG | 63 | 1906 |
| 882031 | N/A | N/A | 7576 | 7591 | ACATAAAGGACCCCGC | 72 | 1907 |
| 882055 | N/A | N/A | 8027 | 8042 | TAGCAAATGGCAAGTT | 83 | 1908 |
| 882079 | N/A | N/A | 8248 | 8263 | GAAGAGATCAGCTGCC | 58 | 1909 |
| 882102 | N/A | N/A | 8475 | 8490 | TGACAGCCGAAGCATT | 62 | 1910 |
| 882126 | N/A | N/A | 9094 | 9109 | GCTAAAGGAGTGCAGG | 93 | 1911 |
| 882149 | N/A | N/A | 9468 | 9483 | AATAAGATCCCACGAA | 85 | 1912 |
| 882172 | N/A | N/A | 9820 | 9835 | ACCCAGCTAATGAGAG | 65 | 1913 |
| 882195 | N/A | N/A | 10098 | 10113 | CTGCAAATCCTCTTG | 133 | 1914 |
| 882219 | N/A | N/A | 10230 | 10245 | CAGTTCTAAGCATTGC | 67 | 1915 |
| 882243 | N/A | N/A | 10551 | 10566 | GACTAACAGGGAGACT | 109 | 1916 |
| 882267 | N/A | N/A | 11014 | 11029 | GTCTAAAGTCCCATCG | 60 | 1917 |
| 882291 | N/A | N/A | 11251 | 11266 | CGTGAGAATGTTGGCT | 51 | 1918 |
| 882315 | N/A | N/A | 11533 | 11548 | TAGTAGGTAAGATCTC | 77 | 1919 |
| 882339 | N/A | N/A | 11799 | 11814 | AGAAAGAGCTGGTAGG | 64 | 1920 |
| 882363 | N/A | N/A | 12074 | 12089 | CCCAAAGAGAGTGGGT | 100 | 1921 |
| 882387 | N/A | N/A | 12364 | 12379 | GTTGAAAGAACCAAGC | 89 | 1922 |
| 882410 | N/A | N/A | 12761 | 12776 | TATAGAATTAGGTGCT | 60 | 1923 |
| 882433 | N/A | N/A | 13112 | 13127 | GGAACAAGTGTATCTT | 24 | 1924 |
| 882457 | N/A | N/A | 13367 | 13382 | CACCACCTCGAGGCCA | 76 | 1925 |
| 882479 | N/A | N/A | 14027 | 14042 | CTGTTTTAAGAGGCGA | 42 | 1926 |
| 882501 | N/A | N/A | 14250 | 14265 | AGCCAACTTATAGCAC | 46 | 1927 |
| 882524 | N/A | N/A | 14649 | 14664 | CAGAAGTACGAGCACA | 53 | 1928 |
| 882547 | N/A | N/A | 15195 | 15210 | CAAGAAGGATGGGACC | 75 | 1929 |
| 882571 | N/A | N/A | 15619 | 15634 | GCTCACAGATTAATAG | 84 | 1930 |
| 882594 | N/A | N/A | 15871 | 15886 | TACACCTACACAGGCT | 81 | 1931 |
| 882617 | N/A | N/A | 16121 | 16136 | CTGCAGAACAGACGCG | 89 | 1932 |
| 882641 | N/A | N/A | 16280 | 16295 | TACAAAACGGACTGGA | 62 | 1933 |
| 882664 | N/A | N/A | 16551 | 16566 | CATAATCCAGTATCTG | 82 | 1934 |
| 882688 | N/A | N/A | 16767 | 16782 | TAGTCGACAGCTAAAG | 54 | 1935 |
| 882712 | N/A | N/A | 17001 | 17016 | GTAGAAGCCCACAAGA | 104 | 1936 |
| 882736 | N/A | N/A | 17404 | 17419 | AATACGACAACTTTCC | 50 | 1937 |
| 882760 | N/A | N/A | 17664 | 17679 | TTGAAAGATTCAGCCT | 97 | 1938 |

TABLE 27-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882784 | N/A | N/A | 17918 | 17933 | GCATGCAAGCCCGTTA | 101 | 1939 |
| 882808 | N/A | N/A | 18183 | 18198 | TTGTTAACAATGTATC | 53 | 1940 |
| 882831 | N/A | N/A | 18715 | 18730 | ACTCATAGGTGTACAC | 55 | 1941 |
| 882855 | N/A | N/A | 19126 | 19141 | GTCTGAGGGAATCTGC | 51 | 1942 |
| 882878 | N/A | N/A | 19384 | 19399 | TTAAACAGCACTCAGA | 67 | 1943 |

TABLE 28

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 20 | 195 |
| 690521 | 4224 | 4239 | 22341 | 22356 | GTAAATGAGTCGGTCA | 21 | 1944 |
| 881090 | 170 | 185 | 5197 | 5212 | CCGCAGCTCACCGCGC | 64 | 1945 |
| 881113 | 488 | 503 | 6967 | 6982 | CTGTACACTTTGTACG | 66 | 1946 |
| 881136 | 837 | 852 | 10902 | 10917 | GGCAGACCTTATGCTT | 79 | 1947 |
| 881160 | 1071 | 1086 | 13624 | 13639 | GGCCATCCAGAGGACC | 75 | 1948 |
| 881184 | 1271 | 1286 | 17064 | 17079 | AAGCATAGAGTCACCT | 64 | 1949 |
| 881208 | 1461 | 1476 | 19578 | 19593 | TTGAATAGAGGAATGG | 58 | 1950 |
| 881232 | 1886 | 1901 | 20003 | 20018 | GTCTACAGAACACAAG | 76 | 1951 |
| 881256 | 1984 | 1999 | 20101 | 20116 | TTCCAGCAAGACCTAA | 73 | 1952 |
| 881280 | 2152 | 2167 | 20269 | 20284 | GCAAGTGTCTTCCACA | 23 | 1953 |
| 881304 | 2312 | 2327 | 20429 | 20444 | AAGTTTACTAACTGGC | 37 | 1954 |
| 881328 | 2462 | 2477 | 20579 | 20594 | CGAAGAATTTTAGCAT | 42 | 1955 |
| 881352 | 2546 | 2561 | 20663 | 20678 | AGGGAACAGATAGTTA | 66 | 1956 |
| 881376 | 2774 | 2789 | 20891 | 20906 | TAATTTTAAGGCCCTG | 61 | 1957 |
| 881400 | 2845 | 2860 | 20962 | 20977 | AGTGATAGGTATACTT | 61 | 1958 |
| 881424 | 2962 | 2977 | 21079 | 21094 | AGCTACGCAATCTTCT | 53 | 1959 |
| 881448 | 3250 | 3265 | 21367 | 21382 | ACTTTTAGAGAGGAGA | 36 | 1960 |
| 881472 | 3394 | 3409 | 21511 | 21526 | ACGAGGTAAATCTTCA | 39 | 1961 |
| 881496 | 3480 | 3495 | 21597 | 21612 | TACATATCCATGTTGC | 26 | 1962 |
| 881519 | 3564 | 3579 | 21681 | 21696 | CCTTAGGATAATATAC | 77 | 1963 |
| 881543 | 3787 | 3802 | 21904 | 21919 | CCACTGTTAAAGCAGC | 34 | 1964 |
| 881567 | 3983 | 3998 | 22100 | 22115 | AATGAGGAAGCCGTTC | 53 | 1965 |
| 881610 | 4384 | 4399 | 22501 | 22516 | AATACTGTAAGGGCTG | 36 | 1966 |
| 881634 | 4506 | 4521 | 22623 | 22638 | CCAAGAGGTGCGAGTA | 67 | 1967 |
| 881658 | 4591 | 4606 | 22708 | 22723 | GAAGTTTACACTGGAT | 35 | 1968 |

TABLE 28-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
| --- | --- | --- | --- | --- | --- | --- | --- |
| 881682 | 4802 | 4817 | 22919 | 22934 | ATCAGTCTCAAAAACG | 59 | 1969 |
| 881706 | 4989 | 5004 | 23106 | 23121 | ACACGGGAATTTCCAT | 44 | 1970 |
| 881730 | 5189 | 5204 | 23306 | 23321 | ACCTCAGTTTGTGAAG | 61 | 1971 |
| 881754 | 5248 | 5263 | 23365 | 23380 | TTGCAGAGCAATTTAC | 50 | 1972 |
| 881778 | N/A | N/A | 18814 | 18829 | CATCAATCATGATATT | 75 | 1973 |
| 881823 | N/A | N/A | 4304 | 4319 | GCTCGGAGCGACCCAA | 92 | 1974 |
| 881846 | N/A | N/A | 4543 | 4558 | CCGAATAGGACCCCTA | 68 | 1975 |
| 881870 | N/A | N/A | 4920 | 4935 | GGCCGGCCCGGGCGCA | 99 | 1976 |
| 881894 | N/A | N/A | 5566 | 5581 | CAGGACCCGGCTCCCG | 86 | 1977 |
| 881917 | N/A | N/A | 5752 | 5767 | CGGACGCACGGAGAGG | 72 | 1978 |
| 881938 | N/A | N/A | 5982 | 5997 | AGGGAGACAGCTCTAG | 75 | 1979 |
| 881962 | N/A | N/A | 6290 | 6305 | GTATTTATAACCGGTA | 33 | 1980 |
| 881984 | N/A | N/A | 7014 | 7029 | CAAATTCAGGAGAGCC | 81 | 1981 |
| 882008 | N/A | N/A | 7247 | 7262 | ACATATTCAATGCACC | 53 | 1982 |
| 882032 | N/A | N/A | 7578 | 7593 | TGACATAAAGGACCCC | 52 | 1983 |
| 882056 | N/A | N/A | 8032 | 8047 | AGCCATAGCAAATGGC | 95 | 1984 |
| 882080 | N/A | N/A | 8302 | 8317 | CTTTTACCCACCAAAG | 82 | 1985 |
| 882103 | N/A | N/A | 8481 | 8496 | TTAGACTGACAGCCGA | 47 | 1986 |
| 882127 | N/A | N/A | 9278 | 9293 | CAATTAGCTCTTCTAT | 86 | 1987 |
| 882150 | N/A | N/A | 9471 | 9486 | TTAAATAAGATCCCAC | 77 | 1988 |
| 882173 | N/A | N/A | 9835 | 9850 | CTAGATTCTCCCTGCA | 66 | 1989 |
| 882196 | N/A | N/A | 10110 | 10125 | AACCAGCCCTTGCTGC | 79 | 1990 |
| 882220 | N/A | N/A | 10237 | 10252 | CTTTACACAGTTCTAA | 113 | 1991 |
| 882244 | N/A | N/A | 10554 | 10569 | ACTGACTAACAGGGAG | 51 | 1992 |
| 882268 | N/A | N/A | 11021 | 11036 | AGCAAGTGTCTAAAGT | 38 | 1993 |
| 882292 | N/A | N/A | 11271 | 11286 | TCCAAGCAATTATTCC | 88 | 1994 |
| 882316 | N/A | N/A | 11534 | 11549 | ATAGTAGGTAAGATCT | 113 | 1995 |
| 882340 | N/A | N/A | 11800 | 11815 | TAGAAAGAGCTGGTAG | 91 | 1996 |
| 882364 | N/A | N/A | 12075 | 12090 | CCCCAAAGAGAGTGGG | 111 | 1997 |
| 882388 | N/A | N/A | 12372 | 12387 | GCCCATGAGTTGAAAG | 68 | 1998 |
| 882411 | N/A | N/A | 12762 | 12777 | ATATAGAATTAGGTGC | 84 | 1999 |
| 882434 | N/A | N/A | 13113 | 13128 | AGGAACAAGTGTATCT | 54 | 2000 |
| 882502 | N/A | N/A | 14254 | 14269 | ACAGAGCCAACTTATA | 94 | 2001 |
| 882525 | N/A | N/A | 14652 | 14667 | ACCCAGAAGTACGAGC | 79 | 2002 |
| 882548 | N/A | N/A | 15218 | 15233 | CCCATGAACACCATGC | 68 | 2003 |
| 882572 | N/A | N/A | 15635 | 15650 | GCCAAGACCAGCTCTT | 70 | 2004 |

TABLE 28-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882595 | N/A | N/A | 15872 | 15887 | CTACACCTACACAGGC | 84 | 2005 |
| 882618 | N/A | N/A | 16132 | 16147 | CGCTACAGCTTCTGCA | 80 | 2006 |
| 882642 | N/A | N/A | 16281 | 16296 | ATACAAAACGGACTGG | 85 | 2007 |
| 882665 | N/A | N/A | 16553 | 16568 | CACATAATCCAGTATC | 57 | 2008 |
| 882689 | N/A | N/A | 16773 | 16788 | AGGAACTAGTCGACAG | 60 | 2009 |
| 882713 | N/A | N/A | 17133 | 17148 | TGTAACTGAGGACTCA | 102 | 2010 |
| 882737 | N/A | N/A | 17405 | 17420 | AAATACGACAACTTTC | 79 | 2011 |
| 882761 | N/A | N/A | 17676 | 17691 | TGCTTGAATTCCTTGA | 33 | 2012 |
| 882785 | N/A | N/A | 17923 | 17938 | GCTCAGCATGCAAGCC | 100 | 2013 |
| 882809 | N/A | N/A | 18225 | 18240 | GCTTATCAATGCCAAG | 60 | 2014 |
| 882832 | N/A | N/A | 18716 | 18731 | AACTCATAGGTGTACA | 39 | 2015 |
| 882856 | N/A | N/A | 19154 | 19169 | TCAAGTAAAGTGATCA | 52 | 2016 |
| 882879 | N/A | N/A | 19387 | 19402 | CTATTAAACAGCACTC | 82 | 2017 |
| 882890 | N/A | N/A | 3949 | 3964 | GTGGGAGTCGGAGCTC | 83 | 2018 |
| 882906 | N/A | N/A | 13375 | 13390 | GCCAAGGACACCACCT | 102 | 2019 |
| 882908 | N/A | N/A | 14061 | 14076 | GTATTTGTCGAGATCA | 41 | 2020 |

TABLE 29

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 33 | 195 |
| 690522 | 4228 | 4243 | 22345 | 22360 | AGTTGTAAATGAGTCG | 15 | 2021 |
| 881091 | 186 | 201 | 5213 | 5228 | GCGGAGCTTCCCGTTG | 67 | 2022 |
| 881114 | 495 | 510 | 6974 | 6989 | AACAATCCTGTACACT | 78 | 2023 |
| 881161 | 1088 | 1103 | 13641 | 13656 | GCATAGAGCCCGTCGG | 50 | 2024 |
| 881185 | 1272 | 1287 | 17065 | 17080 | AAAGCATAGAGTCACC | 66 | 2025 |
| 881209 | 1532 | 1547 | 19649 | 19664 | CCGTATCCCCGTATCA | 65 | 2026 |
| 881233 | 1891 | 1906 | 20008 | 20023 | TGGCAGTCTACAGAAC | 122 | 2027 |
| 881257 | 2001 | 2016 | 20118 | 20133 | GGCAAGTTTTCTCTGT | 64 | 2028 |
| 881281 | 2154 | 2169 | 20271 | 20286 | CAGCAAGTGTCTTCCA | 36 | 2029 |
| 881305 | 2313 | 2328 | 20430 | 20445 | GAAGTTTACTAACTGG | 43 | 2030 |
| 881329 | 2463 | 2478 | 20580 | 20595 | GCGAAGAATTTTAGCA | 88 | 2031 |
| 881353 | 2547 | 2562 | 20664 | 20679 | AAGGGAACAGATAGTT | 80 | 2032 |
| 881377 | 2775 | 2790 | 20892 | 20907 | GTAATTTTAAGGCCCT | 45 | 2033 |
| 881401 | 2846 | 2861 | 20963 | 20978 | AAGTGATAGGTATACT | 50 | 2034 |

TABLE 29-continued

Percent control of human IRF4 mRNA with 3-10-3 cEt gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881425 | 2965 | 2980 | 21082 | 21097 | GAGAGCTACGCAATCT | 43 | 2035 |
| 881449 | 3251 | 3266 | 21368 | 21383 | CACTTTTAGAGAGGAG | 38 | 2036 |
| 881473 | 3395 | 3410 | 21512 | 21527 | AACGAGGTAAATCTTC | 49 | 2037 |
| 881497 | 3484 | 3499 | 21601 | 21616 | CCAATACATATCCATG | 40 | 2038 |
| 881520 | 3566 | 3581 | 21683 | 21698 | TCCCTTAGGATAATAT | 52 | 2039 |
| 881544 | 3788 | 3803 | 21905 | 21920 | TCCACTGTTAAAGCAG | 45 | 2040 |
| 881568 | 3984 | 3999 | 22101 | 22116 | GAATGAGGAAGCCGTT | 61 | 2041 |
| 881611 | 4385 | 4400 | 22502 | 22517 | CAATACTGTAAGGGCT | 44 | 2042 |
| 881635 | 4507 | 4522 | 22624 | 22639 | GCCAAGAGGTGCGAGT | 65 | 2043 |
| 881659 | 4592 | 4607 | 22709 | 22724 | GGAAGTTTACACTGGA | 15 | 2044 |
| 881683 | 4808 | 4823 | 22925 | 22940 | ATCGAGATCAGTCTCA | 24 | 2045 |
| 881707 | 4991 | 5006 | 23108 | 23123 | CAACACGGGAATTTCC | 45 | 2046 |
| 881731 | 5191 | 5206 | 23308 | 23323 | CTACCTCAGTTTGTGA | 59 | 2047 |
| 881755 | N/A | N/A | 18767 | 18782 | CTAAACTCCTAAGTAC | 86 | 2048 |
| 881779 | N/A | N/A | 18827 | 18842 | GCTGAATGCTCTCCAT | 48 | 2049 |
| 881802 | N/A | N/A | 3965 | 3980 | GCTCAGCGCAGATGGG | 102 | 2050 |
| 881824 | N/A | N/A | 4310 | 4325 | CGCAAGGCTCGGAGCG | 90 | 2051 |
| 881847 | N/A | N/A | 4544 | 4559 | CCCGAATAGGACCCCT | 60 | 2052 |
| 881871 | N/A | N/A | 4932 | 4947 | AGGCACCTTCGCGGCC | 82 | 2053 |
| 881918 | N/A | N/A | 5754 | 5769 | CGCGGACGCACGGAGA | 81 | 2054 |
| 881939 | N/A | N/A | 5995 | 6010 | CGCGCAAAGGGCAAGG | 66 | 2055 |
| 881963 | N/A | N/A | 6292 | 6307 | GGGTATTTATAACCGG | 41 | 2056 |
| 881985 | N/A | N/A | 7032 | 7047 | TGCCTCTGTTAGGTGA | 66 | 2057 |
| 882009 | N/A | N/A | 7268 | 7283 | TTGAAAGACTAACTGG | 80 | 2058 |
| 882033 | N/A | N/A | 7580 | 7595 | TGTGACATAAAGGACC | 73 | 2059 |
| 882057 | N/A | N/A | 8040 | 8055 | GTTGGAGCAGCCATAG | 69 | 2060 |
| 882081 | N/A | N/A | 8329 | 8344 | CAAAAGTACCACAGGG | 60 | 2061 |
| 882104 | N/A | N/A | 8484 | 8499 | TTATTAGACTGACAGC | 63 | 2062 |
| 882128 | N/A | N/A | 9279 | 9294 | GCAATTAGCTCTTCTA | 79 | 2063 |
| 882151 | N/A | N/A | 9525 | 9540 | CTATATAAAAAGTGGG | 84 | 2064 |
| 882174 | N/A | N/A | 9837 | 9852 | TGCTAGATTCTCCCTG | 67 | 2065 |
| 882197 | N/A | N/A | 10114 | 10129 | TGGAAACCAGCCCTTG | 52 | 2066 |
| 882221 | N/A | N/A | 10250 | 10265 | ACCTACTCCATCACTT | 103 | 2067 |
| 882245 | N/A | N/A | 10559 | 10574 | CTGTAACTGACTAACA | 77 | 2068 |
| 882269 | N/A | N/A | 11022 | 11037 | AAGCAAGTGTCTAAAG | 71 | 2069 |
| 882293 | N/A | N/A | 11278 | 11293 | CTACACTTCCAAGCAA | 105 | 2070 |

TABLE 29-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882317 | N/A | N/A | 11535 | 11550 | TATAGTAGGTAAGATC | 87 | 2071 |
| 882341 | N/A | N/A | 11801 | 11816 | CTAGAAAGAGCTGGTA | 85 | 2072 |
| 882365 | N/A | N/A | 12087 | 12102 | TCAGACAGTGCGCCCC | 74 | 2073 |
| 882389 | N/A | N/A | 12379 | 12394 | AAATATCGCCCATGAG | 61 | 2074 |
| 882412 | N/A | N/A | 12763 | 12778 | TATATAGAATTAGGTG | 116 | 2075 |
| 882435 | N/A | N/A | 13115 | 13130 | TAAGGAACAAGTGTAT | 82 | 2076 |
| 882458 | N/A | N/A | 13393 | 13408 | CCGGAGTCAGTGCTGG | 107 | 2077 |
| 882480 | N/A | N/A | 14062 | 14077 | CGTATTTGTCGAGATC | 50 | 2078 |
| 882503 | N/A | N/A | 14256 | 14271 | TCACAGAGCCAACTTA | 112 | 2079 |
| 882526 | N/A | N/A | 14656 | 14671 | TTACACCCAGAAGTAC | 95 | 2080 |
| 882549 | N/A | N/A | 15312 | 15327 | GCCCATGTGAGCTCTT | 50 | 2081 |
| 882573 | N/A | N/A | 15704 | 15719 | GAACACTTTGAGGTGA | 86 | 2082 |
| 882596 | N/A | N/A | 15874 | 15889 | GACTACACCTACACAG | 68 | 2083 |
| 882619 | N/A | N/A | 16135 | 16150 | AGCCGCTACAGCTTCT | 108 | 2084 |
| 882643 | N/A | N/A | 16282 | 16297 | GATACAAAACGGACTG | 56 | 2085 |
| 882666 | N/A | N/A | 16556 | 16571 | GCCCACATAATCCAGT | 78 | 2086 |
| 882690 | N/A | N/A | 16774 | 16789 | GAGGAACTAGTCGACA | 61 | 2087 |
| 882714 | N/A | N/A | 17139 | 17154 | TAGGAGTGTAACTGAG | 63 | 2088 |
| 882738 | N/A | N/A | 17406 | 17421 | GAAATACGACAACTTT | 78 | 2089 |
| 882762 | N/A | N/A | 17693 | 17708 | TACGAGAGGGTCTGAT | 100 | 2090 |
| 882786 | N/A | N/A | 17936 | 17951 | TTTACCTGGTATTGCT | 62 | 2091 |
| 882810 | N/A | N/A | 18226 | 18241 | TGCTTATCAATGCCAA | 30 | 2092 |
| 882833 | N/A | N/A | 18717 | 18732 | GAACTCATAGGTGTAC | 33 | 2093 |
| 882880 | N/A | N/A | 19389 | 19404 | CACTATTAAACAGCAC | 81 | 2094 |
| 882916 | N/A | N/A | 19155 | 19170 | ATCAAGTAAAGTGATC | 71 | 2095 |

TABLE 30

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 29 | 195 |
| 690523 | 4230 | 4245 | 22347 | 22362 | TCAGTTGTAAATGAGT | 28 | 2096 |
| 881092 | 187 | 202 | 5214 | 5229 | GGCGGAGCTTCCCGTT | 74 | 2097 |
| 881115 | 498 | 513 | 6977 | 6992 | AGGAACAATCCTGTAC | 84 | 2098 |
| 881162 | 1089 | 1104 | 13642 | 13657 | CGCATAGAGCCCGTCG | 47 | 2099 |
| 881186 | 1273 | 1288 | 17066 | 17081 | CAAAGCATAGAGTCAC | 64 | 2100 |

TABLE 30-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881210 | 1534 | 1549 | 19651 | 19666 | CCCCGTATCCCCGTAT | 55 | 2101 |
| 881234 | 1896 | 1911 | 20013 | 20028 | AATGATGGCAGTCTAC | 67 | 2102 |
| 881258 | 2014 | 2029 | 20131 | 20146 | GTCAATACTGAAAGGC | 34 | 2103 |
| 881282 | 2155 | 2170 | 20272 | 20287 | TCAGCAAGTGTCTTCC | 34 | 2104 |
| 881306 | 2316 | 2331 | 20433 | 20448 | TAGGAAGTTTACTAAC | 64 | 2105 |
| 881330 | 2464 | 2479 | 20581 | 20596 | TGCGAAGAATTTTAGC | 59 | 2106 |
| 881354 | 2548 | 2563 | 20665 | 20680 | GAAGGGAACAGATAGT | 83 | 2107 |
| 881378 | 2776 | 2791 | 20893 | 20908 | AGTAATTTTAAGGCCC | 40 | 2108 |
| 881402 | 2847 | 2862 | 20964 | 20979 | TAAGTGATAGGTATAC | 40 | 2109 |
| 881426 | 2972 | 2987 | 21089 | 21104 | CACATTTGAGAGCTAC | 26 | 2110 |
| 881450 | 3252 | 3267 | 21369 | 21384 | ACACTTTTAGAGAGGA | 37 | 2111 |
| 881474 | 3396 | 3411 | 21513 | 21528 | GAACGAGGTAAATCTT | 44 | 2112 |
| 881498 | 3485 | 3500 | 21602 | 21617 | CCCAATACATATCCAT | 26 | 2113 |
| 881521 | 3600 | 3615 | 21717 | 21732 | CGTGAAACAGCAGTTC | 60 | 2114 |
| 881545 | 3789 | 3804 | 21906 | 21921 | CTCCACTGTTAAAGCA | 48 | 2115 |
| 881569 | 3986 | 4001 | 22103 | 22118 | AGGAATGAGGAAGCCG | 44 | 2116 |
| 881612 | 4387 | 4402 | 22504 | 22519 | AACAATACTGTAAGGG | 49 | 2117 |
| 881636 | 4508 | 4523 | 22625 | 22640 | AGCCAAGAGGTGCGAG | 62 | 2118 |
| 881660 | 4593 | 4608 | 22710 | 22725 | CGGAAGTTTACACTGG | 15 | 2119 |
| 881684 | 4809 | 4824 | 22926 | 22941 | CATCGAGATCAGTCTC | 35 | 2120 |
| 881708 | 4993 | 5008 | 23110 | 23125 | AGCAACACGGGAATTT | 43 | 2121 |
| 881732 | 5197 | 5212 | 23314 | 23329 | CATTATCTACCTCAGT | 65 | 2122 |
| 881756 | N/A | N/A | 18768 | 18783 | GCTAAACTCCTAAGTA | 70 | 2123 |
| 881780 | N/A | N/A | 18828 | 18843 | AGCTGAATGCTCTCCA | 22 | 2124 |
| 881803 | N/A | N/A | 3993 | 4008 | GGCCTTGGAGCCCAAA | 80 | 2125 |
| 881825 | N/A | N/A | 4311 | 4326 | ACGCAAGGCTCGGAGC | 79 | 2126 |
| 881848 | N/A | N/A | 4545 | 4560 | CCCCGAATAGGACCCC | 44 | 2127 |
| 881872 | N/A | N/A | 4937 | 4952 | GAAGAAGGCACCTTCG | 75 | 2128 |
| 881896 | N/A | N/A | 5646 | 5661 | GCAAACCCCTCAAGC | 80 | 2129 |
| 881919 | N/A | N/A | 5755 | 5770 | GCGCGGACGCACGGAG | 98 | 2130 |
| 881940 | N/A | N/A | 6001 | 6016 | TGCACTCGCGCAAAGG | 72 | 2131 |
| 881964 | N/A | N/A | 6315 | 6330 | GCCAAGTTGAAGACAC | 43 | 2132 |
| 881986 | N/A | N/A | 7057 | 7072 | AGTTAAGGTGCCTCAA | 101 | 2133 |
| 882010 | N/A | N/A | 7304 | 7319 | TAACAAGTTATCCAGT | 88 | 2134 |
| 882034 | N/A | N/A | 7593 | 7608 | TGCGAATGTGCCTTGT | 57 | 2135 |
| 882058 | N/A | N/A | 8095 | 8110 | CAGCACCGTGTGGAAA | 49 | 2136 |

TABLE 30-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882082 | N/A | N/A | 8335 | 8350 | TGGCACCAAAAGTACC | 66 | 2137 |
| 882105 | N/A | N/A | 8485 | 8500 | CTTATTAGACTGACAG | 59 | 2138 |
| 882129 | N/A | N/A | 9287 | 9302 | CCACATTAGCAATTAG | 81 | 2139 |
| 882152 | N/A | N/A | 9550 | 9565 | TTTATGAGCTTCCACA | 46 | 2140 |
| 882175 | N/A | N/A | 9843 | 9858 | CCGCATTGCTAGATTC | 28 | 2141 |
| 882198 | N/A | N/A | 10115 | 10130 | TTGGAAACCAGCCCTT | 61 | 2142 |
| 882222 | N/A | N/A | 10253 | 10268 | TCTACCTACTCCATCA | 53 | 2143 |
| 882246 | N/A | N/A | 10580 | 10595 | AGGAAACTTGGAGCGC | 23 | 2144 |
| 882270 | N/A | N/A | 11025 | 11040 | GCAAAGCAAGTGTCTA | 57 | 2145 |
| 882294 | N/A | N/A | 11313 | 11328 | GAAGGATGATCAGCTT | 74 | 2146 |
| 882318 | N/A | N/A | 11536 | 11551 | TTATAGTAGGTAAGAT | 98 | 2147 |
| 882342 | N/A | N/A | 11819 | 11834 | TGCAAGCCTCATTCAC | 58 | 2148 |
| 882366 | N/A | N/A | 12089 | 12104 | AGTCAGACAGTGCGCC | 90 | 2149 |
| 882390 | N/A | N/A | 12380 | 12395 | AAAATATCGCCCATGA | 59 | 2150 |
| 882413 | N/A | N/A | 12827 | 12842 | TGACATCATTTAGGTA | 46 | 2151 |
| 882436 | N/A | N/A | 13133 | 13148 | GGCCACCGACTCTTTT | 87 | 2152 |
| 882459 | N/A | N/A | 13780 | 13795 | ATAACGAGGTGCCTTA | 87 | 2153 |
| 882481 | N/A | N/A | 14077 | 14092 | CGCCACATCAGCAGAC | 88 | 2154 |
| 882527 | N/A | N/A | 14658 | 14673 | ACTTACACCCAGAAGT | 110 | 2155 |
| 882550 | N/A | N/A | 15328 | 15343 | GGCCTTAGCCTTCCTG | 83 | 2156 |
| 882574 | N/A | N/A | 15765 | 15780 | GCAGAAGCTGGTTGGC | 42 | 2157 |
| 882597 | N/A | N/A | 15877 | 15892 | TGAGACTACACCTACA | 81 | 2158 |
| 882620 | N/A | N/A | 16140 | 16155 | ACAGGAGCCGCTACAG | 69 | 2159 |
| 882644 | N/A | N/A | 16284 | 16299 | AAGATACAAAACGGAC | 61 | 2160 |
| 882667 | N/A | N/A | 16568 | 16583 | CCTCACTACAGAGCCC | 76 | 2161 |
| 882691 | N/A | N/A | 16778 | 16793 | TCAAGAGGAACTAGTC | 76 | 2162 |
| 882715 | N/A | N/A | 17140 | 17155 | GTAGGAGTGTAACTGA | 59 | 2163 |
| 882739 | N/A | N/A | 17407 | 17422 | GGAAATACGACAACTT | 37 | 2164 |
| 882763 | N/A | N/A | 17694 | 17709 | TTACGAGGGTCTGA | 49 | 2165 |
| 882787 | N/A | N/A | 17937 | 17952 | TTTTACCTGGTATTGC | 102 | 2166 |
| 882811 | N/A | N/A | 18247 | 18262 | GATCATCAACTTCTTA | 53 | 2167 |
| 882834 | N/A | N/A | 18719 | 18734 | TGGAACTCATAGGTGT | 38 | 2168 |
| 882857 | N/A | N/A | 19164 | 19179 | CTGCATCAAATCAAGT | 53 | 2169 |
| 882881 | N/A | N/A | 19390 | 19405 | TCACTATTAAACAGCA | 84 | 2170 |
| 882910 | N/A | N/A | 14263 | 14278 | GTTCATATCACAGAGC | 55 | 2171 |

TABLE 31

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 23 | 195 |
| 690526 | 4234 | 4249 | 22351 | 22366 | GGTTTCAGTTGTAAAT | 42 | 2172 |
| 881093 | 193 | 208 | 5220 | 5235 | GCCACTGGCGGAGCTT | 77 | 2173 |
| 881116 | 554 | 569 | 7872 | 7887 | ATGGACATCTGCGGGT | 50 | 2174 |
| 881163 | 1090 | 1105 | 13643 | 13658 | TCGCATAGAGCCCGTC | 43 | 2175 |
| 881187 | 1274 | 1289 | 17067 | 17082 | CCAAAGCATAGAGTCA | 42 | 2176 |
| 881211 | 1539 | 1554 | 19656 | 19671 | CAAGACCCCGTATCCC | 56 | 2177 |
| 881235 | 1897 | 1912 | 20014 | 20029 | CAATGATGGCAGTCTA | 60 | 2178 |
| 881259 | 2015 | 2030 | 20132 | 20147 | TGTCAATACTGAAAGG | 64 | 2179 |
| 881283 | 2156 | 2171 | 20273 | 20288 | CTCAGCAAGTGTCTTC | 55 | 2180 |
| 881307 | 2317 | 2332 | 20434 | 20449 | ATAGGAAGTTTACTAA | 87 | 2181 |
| 881331 | 2465 | 2480 | 20582 | 20597 | ATGCGAAGAATTTTAG | 79 | 2182 |
| 881355 | 2583 | 2598 | 20700 | 20715 | GGACAGCCAAACAAAC | 93 | 2183 |
| 881379 | 2778 | 2793 | 20895 | 20910 | CAAGTAATTTTAAGGC | 59 | 2184 |
| 881403 | 2849 | 2864 | 20966 | 20981 | TGTAAGTGATAGGTAT | 47 | 2185 |
| 881427 | 2973 | 2988 | 21090 | 21105 | ACACATTTGAGAGCTA | 31 | 2186 |
| 881451 | 3254 | 3269 | 21371 | 21386 | GGACACTTTTAGAGAG | 38 | 2187 |
| 881475 | 3397 | 3412 | 21514 | 21529 | AGAACGAGGTAAATCT | 60 | 2188 |
| 881499 | 3486 | 3501 | 21603 | 21618 | GCCCAATACATATCCA | 42 | 2189 |
| 881522 | 3601 | 3616 | 21718 | 21733 | CCGTGAAACAGCAGTT | 44 | 2190 |
| 881546 | 3791 | 3806 | 21908 | 21923 | AGCTCCACTGTTAAAG | 56 | 2191 |
| 881570 | 3999 | 4014 | 22116 | 22131 | CTTTATCAAGACAAGG | 44 | 2192 |
| 881613 | 4388 | 4403 | 22505 | 22520 | TAACAATACTGTAAGG | 55 | 2193 |
| 881637 | 4523 | 4538 | 22640 | 22655 | GCGGAGCATCAACAAA | 70 | 2194 |
| 881661 | 4594 | 4609 | 22711 | 22726 | ACGGAAGTTTACACTG | 23 | 2195 |
| 881685 | 4810 | 4825 | 22927 | 22942 | GCATCGAGATCAGTCT | 43 | 2196 |
| 881709 | 4994 | 5009 | 23111 | 23126 | AAGCAACACGGGAATT | 78 | 2197 |
| 881733 | 5198 | 5213 | 23315 | 23330 | GCATTATCTACCTCAG | 31 | 2198 |
| 881757 | N/A | N/A | 18769 | 18784 | AGCTAAACTCCTAAGT | 85 | 2199 |
| 881781 | N/A | N/A | 18832 | 18847 | GGCAAGCTGAATGCTC | 71 | 2200 |
| 881804 | N/A | N/A | 4002 | 4017 | AAGGAGGCGGGCCTTG | 98 | 2201 |
| 881826 | N/A | N/A | 4315 | 4330 | CCGCACGCAAGGCTCG | 84 | 2202 |
| 881849 | N/A | N/A | 4563 | 4578 | TCGCATCCAGACCCTT | 72 | 2203 |
| 881873 | N/A | N/A | 4939 | 4954 | CGGAAGAAGGCACCTT | 112 | 2204 |
| 881897 | N/A | N/A | 5647 | 5662 | CGCAAAACCCCTCAAG | 81 | 2205 |
| 881920 | N/A | N/A | 5760 | 5775 | CACAGGCGCGGACGCA | 86 | 2206 |
| 881941 | N/A | N/A | 6021 | 6036 | GTAACAACGACACACG | 41 | 2207 |

TABLE 31-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881965 | N/A | N/A | 6325 | 6340 | CCCTATCACTGCCAAG | 62 | 2208 |
| 881987 | N/A | N/A | 7065 | 7080 | CAGAATGAAGTTAAGG | 50 | 2209 |
| 882011 | N/A | N/A | 7325 | 7340 | GACTATTAGATAAGTA | 71 | 2210 |
| 882035 | N/A | N/A | 7602 | 7617 | CAGATGGCATGCGAAT | 65 | 2211 |
| 882059 | N/A | N/A | 8097 | 8112 | GGCAGCACCGTGTGGA | 47 | 2212 |
| 882083 | N/A | N/A | 8344 | 8359 | GGCTAAACCTGGCACC | 60 | 2213 |
| 882106 | N/A | N/A | 8486 | 8501 | CCTTATTAGACTGACA | 52 | 2214 |
| 882130 | N/A | N/A | 9288 | 9303 | GCCACATTAGCAATTA | 92 | 2215 |
| 882153 | N/A | N/A | 9557 | 9572 | CTTATTATTTATGAGC | 63 | 2216 |
| 882176 | N/A | N/A | 9845 | 9860 | TACCGCATTGCTAGAT | 77 | 2217 |
| 882199 | N/A | N/A | 10119 | 10134 | CATATTGGAAACCAGC | 27 | 2218 |
| 882223 | N/A | N/A | 10264 | 10279 | CAAGACAGGTCTCTAC | 66 | 2219 |
| 882247 | N/A | N/A | 10581 | 10596 | AAGGAAACTTGGAGCG | 41 | 2220 |
| 882271 | N/A | N/A | 11026 | 11041 | AGCAAAGCAAGTGTCT | 42 | 2221 |
| 882295 | N/A | N/A | 11321 | 11336 | TCAACCTGGAAGGATG | 70 | 2222 |
| 882319 | N/A | N/A | 11537 | 11552 | TTTATAGTAGGTAAGA | 94 | 2223 |
| 882343 | N/A | N/A | 11827 | 11842 | AAAAAAGGTGCAAGCC | 93 | 2224 |
| 882367 | N/A | N/A | 12093 | 12108 | AGCGAGTCAGACAGTG | 84 | 2225 |
| 882391 | N/A | N/A | 12382 | 12397 | TTAAAATATCGCCCAT | 68 | 2226 |
| 882414 | N/A | N/A | 12871 | 12886 | AGCAAGTCGGTCCACA | 46 | 2227 |
| 882437 | N/A | N/A | 13154 | 13169 | CAGCATATTACAAACG | 42 | 2228 |
| 882460 | N/A | N/A | 13781 | 13796 | GATAACGAGGTGCCTT | 82 | 2229 |
| 882504 | N/A | N/A | 14295 | 14310 | ACTCACTGGTTCTGAA | 86 | 2230 |
| 882528 | N/A | N/A | 14661 | 14676 | GTCACTTACACCCAGA | 48 | 2231 |
| 882551 | N/A | N/A | 15359 | 15374 | GTCCAGAGTCTTCAGA | 94 | 2232 |
| 882575 | N/A | N/A | 15772 | 15787 | TAATTATGCAGAAGCT | 103 | 2233 |
| 882598 | N/A | N/A | 15879 | 15894 | TCTGAGACTACACCTA | 73 | 2234 |
| 882621 | N/A | N/A | 16146 | 16161 | GTTGACACAGGAGCCG | 47 | 2235 |
| 882645 | N/A | N/A | 16285 | 16300 | AAAGATACAAAACGGA | 62 | 2236 |
| 882668 | N/A | N/A | 16581 | 16596 | TAAAACCTCATCCCCT | 126 | 2237 |
| 882692 | N/A | N/A | 16779 | 16794 | TTCAAGAGGAACTAGT | 94 | 2238 |
| 882716 | N/A | N/A | 17146 | 17161 | ACTATGGTAGGAGTGT | 75 | 2239 |
| 882740 | N/A | N/A | 17409 | 17424 | ATGGAAATACGACAAC | 65 | 2240 |
| 882764 | N/A | N/A | 17696 | 17711 | CATTACGAGAGGGTCT | 56 | 2241 |
| 882788 | N/A | N/A | 17940 | 17955 | AACTTTTACCTGGTAT | 72 | 2242 |
| 882812 | N/A | N/A | 18251 | 18266 | GGCCGATCATCAACTT | 93 | 2243 |

TABLE 31-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882835 | N/A | N/A | 18720 | 18735 | GTGGAACTCATAGGTG | 47 | 2244 |
| 882858 | N/A | N/A | 19173 | 19188 | TAACTAAAACTGCATC | 90 | 2245 |
| 882882 | N/A | N/A | 19391 | 19406 | CTCACTATTAAACAGC | 76 | 2246 |
| 882909 | N/A | N/A | 14080 | 14095 | AGCCGCCACATCAGCA | 79 | 2247 |

TABLE 32

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 26 | 195 |
| 881094 | 194 | 209 | 5221 | 5236 | AGCCACTGGCGGAGCT | 62 | 2248 |
| 881117 | 558 | 573 | 7876 | 7891 | GCTCATGGACATCTGC | 61 | 2249 |
| 881164 | 1097 | 1112 | 13650 | 13665 | AGTCTTTTCGCATAGA | 55 | 2250 |
| 881188 | 1276 | 1291 | 17069 | 17084 | CTCCAAAGCATAGAGT | 77 | 2251 |
| 881212 | 1685 | 1700 | 19802 | 19817 | AATCACTTGTCTTGGG | 40 | 2252 |
| 881236 | 1898 | 1913 | 20015 | 20030 | TCAATGATGGCAGTCT | 46 | 2253 |
| 881260 | 2021 | 2036 | 20138 | 20153 | AGTCAGTGTCAATACT | 53 | 2254 |
| 881284 | 2157 | 2172 | 20274 | 20289 | ACTCAGCAAGTGTCTT | 53 | 2255 |
| 881308 | 2341 | 2356 | 20458 | 20473 | GCTCATGTTTTTTGAC | 44 | 2256 |
| 881332 | 2469 | 2484 | 20586 | 20601 | CTTTATGCGAAGAATT | 70 | 2257 |
| 881356 | 2587 | 2602 | 20704 | 20719 | CGCTGGACAGCCAAAC | 59 | 2258 |
| 881380 | 2780 | 2795 | 20897 | 20912 | GCCAAGTAATTTTAAG | 65 | 2259 |
| 881404 | 2850 | 2865 | 20967 | 20982 | ATGTAAGTGATAGGTA | 30 | 2260 |
| 881428 | 2995 | 3010 | 21112 | 21127 | TATCCATTAGAAAAGC | 37 | 2261 |
| 881452 | 3255 | 3270 | 21372 | 21387 | TGGACACTTTTAGAGA | 28 | 2262 |
| 881476 | 3398 | 3413 | 21515 | 21530 | CAGAACGAGGTAAATC | 41 | 2263 |
| 881500 | 3487 | 3502 | 21604 | 21619 | TGCCCAATACATATCC | 41 | 2264 |
| 881523 | 3611 | 3626 | 21728 | 21743 | GGTAAGGGCCCCGTGA | 67 | 2265 |
| 881547 | 3835 | 3850 | 21952 | 21967 | AAGGAGGTAGTGGCCC | 53 | 2266 |
| 881571 | 4009 | 4024 | 22126 | 22141 | GCCAATTCCACTTTAT | 36 | 2267 |
| 881590 | 4239 | 4254 | 22356 | 22371 | TCCTAGGTTTCAGTTG | 52 | 2268 |
| 881614 | 4389 | 4404 | 22506 | 22521 | GTAACAATACTGTAAG | 45 | 2269 |
| 881638 | 4524 | 4539 | 22641 | 22656 | GGCGGAGCATCAACAA | 40 | 2270 |
| 881662 | 4595 | 4610 | 22712 | 22727 | AACGGAAGTTTACACT | 41 | 2271 |
| 881686 | 4812 | 4827 | 22929 | 22944 | CTGCATCGAGATCAGT | 48 | 2272 |
| 881710 | 4996 | 5011 | 23113 | 23128 | TGAAGCAACACGGGAA | 40 | 2273 |

TABLE 32-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881734 | 5199 | 5214 | 23316 | 23331 | AGCATTATCTACCTCA | 22 | 2274 |
| 881758 | N/A | N/A | 18770 | 18785 | AAGCTAAACTCCTAAG | 85 | 2275 |
| 881782 | N/A | N/A | 18837 | 18852 | TCTAAGGCAAGCTGAA | 79 | 2276 |
| 881805 | N/A | N/A | 4003 | 4018 | CAAGGAGGCGGGCCTT | 102 | 2277 |
| 881827 | N/A | N/A | 4325 | 4340 | GGCTAGGCCACCGCAC | 72 | 2278 |
| 881850 | N/A | N/A | 4633 | 4648 | GAGGACCTCGCCTGCG | 102 | 2279 |
| 881874 | N/A | N/A | 4940 | 4955 | CCGGAAGAAGGCACCT | 83 | 2280 |
| 881898 | N/A | N/A | 5648 | 5663 | GCGCAAAACCCCTCAA | 78 | 2281 |
| 881921 | N/A | N/A | 5763 | 5778 | CGGCACAGGCGCGGAC | 96 | 2282 |
| 881942 | N/A | N/A | 6047 | 6062 | GTAAACTGCCTTAGGG | 56 | 2283 |
| 881966 | N/A | N/A | 6369 | 6384 | AAAGACCCCAGCTATG | 77 | 2284 |
| 881988 | N/A | N/A | 7068 | 7083 | GCTCAGAATGAAGTTA | 52 | 2285 |
| 882012 | N/A | N/A | 7327 | 7342 | AAGACTATTAGATAAG | 78 | 2286 |
| 882036 | N/A | N/A | 7629 | 7644 | GTACAGGACAGGTAAA | 75 | 2287 |
| 882060 | N/A | N/A | 8103 | 8118 | ACCAATGGCAGCACCG | 39 | 2288 |
| 882084 | N/A | N/A | 8347 | 8362 | TATGGCTAAACCTGGC | 57 | 2289 |
| 882107 | N/A | N/A | 8487 | 8502 | CCCTTATTAGACTGAC | 33 | 2290 |
| 882131 | N/A | N/A | 9312 | 9327 | GACCAGGATTCGCCAT | 77 | 2291 |
| 882177 | N/A | N/A | 9850 | 9865 | TGAGTTACCGCATTGC | 20 | 2292 |
| 882200 | N/A | N/A | 10121 | 10136 | ACCATATTGGAAACCA | 26 | 2293 |
| 882224 | N/A | N/A | 10278 | 10293 | TGTTACCGATGCTTCA | 51 | 2294 |
| 882248 | N/A | N/A | 10606 | 10621 | GAAACGAGCCAGTGCA | 48 | 2295 |
| 882272 | N/A | N/A | 11027 | 11042 | GAGCAAAGCAAGTGTC | 58 | 2296 |
| 882296 | N/A | N/A | 11323 | 11338 | GCTCAACCTGGAAGGA | 75 | 2297 |
| 882320 | N/A | N/A | 11541 | 11556 | CTTCTTTATAGTAGGT | 80 | 2298 |
| 882344 | N/A | N/A | 11843 | 11858 | TCACGAGCACCTCAGA | 64 | 2299 |
| 882368 | N/A | N/A | 12111 | 12126 | TTCAACACACTGTCTG | 131 | 2300 |
| 882392 | N/A | N/A | 12386 | 12401 | CTCTTTAAAATATCGC | 44 | 2301 |
| 882415 | N/A | N/A | 12872 | 12887 | AAGCAAGTCGGTCCAC | 68 | 2302 |
| 882438 | N/A | N/A | 13161 | 13176 | TCTAAACCAGCATATT | 67 | 2303 |
| 882482 | N/A | N/A | 14085 | 14100 | AAAAGAGCCGCCACAT | 84 | 2304 |
| 882505 | N/A | N/A | 14321 | 14336 | CATGAAATCCAAGGTA | 51 | 2305 |
| 882529 | N/A | N/A | 14671 | 14686 | AAAAACTTGGGTCACT | 119 | 2306 |
| 882552 | N/A | N/A | 15366 | 15381 | CACCAAGGTCCAGAGT | 80 | 2307 |
| 882599 | N/A | N/A | 15893 | 15908 | TCACACTGCCGTGATC | 78 | 2308 |
| 882622 | N/A | N/A | 16151 | 16166 | AACGAGTTGACACAGG | 45 | 2309 |

TABLE 32-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882646 | N/A | N/A | 16314 | 16329 | GTACATCCTGAAGCCA | 74 | 2310 |
| 882669 | N/A | N/A | 16612 | 16627 | ATCAGAATGTTTCGAC | 54 | 2311 |
| 882693 | N/A | N/A | 16807 | 16822 | CCCCAGGGCCCTCGGT | 82 | 2312 |
| 882717 | N/A | N/A | 17147 | 17162 | CACTATGGTAGGAGTG | 112 | 2313 |
| 882741 | N/A | N/A | 17448 | 17463 | GGGCAACTTTAACCAT | 92 | 2314 |
| 882765 | N/A | N/A | 17699 | 17714 | GAACATTACGAGAGGG | 30 | 2315 |
| 882789 | N/A | N/A | 17945 | 17960 | GGTGTAACTTTTACCT | 89 | 2316 |
| 882813 | N/A | N/A | 18558 | 18573 | GATCATCAACTTCTTT | 57 | 2317 |
| 882836 | N/A | N/A | 18760 | 18775 | CCTAAGTACCTGAAAT | 89 | 2318 |
| 882859 | N/A | N/A | 19203 | 19218 | TCAAATCGACTGCCAC | 46 | 2319 |
| 882883 | N/A | N/A | 19392 | 19407 | GCTCACTATTAAACAG | 112 | 2320 |
| 882902 | N/A | N/A | 9579 | 9594 | CAATAATCTCCCAGCA | 63 | 2321 |
| 882907 | N/A | N/A | 13782 | 13797 | AGATAACGAGGTGCCT | 77 | 2322 |
| 882912 | N/A | N/A | 15773 | 15788 | TTAATTATGCAGAAGC | 87 | 2323 |

TABLE 33

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 26 | 195 |
| 881095 | 217 | 232 | 5244 | 5259 | TGCCGCTGTCGATCTG | 68 | 2324 |
| 881118 | 559 | 574 | 7877 | 7892 | GGCTCATGGACATCTG | 64 | 2325 |
| 881165 | 1103 | 1118 | 13656 | 13671 | TGGCACAGTCTTTTCG | 72 | 2326 |
| 881189 | 1341 | 1356 | 19458 | 19473 | GGCTAGCAGAGGTTCT | 49 | 2327 |
| 881213 | 1717 | 1732 | 19834 | 19849 | CGCTTTCACTAAAGTC | 29 | 2328 |
| 881237 | 1900 | 1915 | 20017 | 20032 | CATCAATGATGGCAGT | 50 | 2329 |
| 881261 | 2025 | 2040 | 20142 | 20157 | CTCTAGTCAGTGTCAA | 41 | 2330 |
| 881285 | 2158 | 2173 | 20275 | 20290 | CACTCAGCAAGTGTCT | 50 | 2331 |
| 881309 | 2358 | 2373 | 20475 | 20490 | TCCCATCCAAGAGTAG | 67 | 2332 |
| 881333 | 2470 | 2485 | 20587 | 20602 | TCTTTATGCGAAGAAT | 58 | 2333 |
| 881357 | 2600 | 2615 | 20717 | 20732 | CGCCATGGCTGATCGC | 47 | 2334 |
| 881381 | 2817 | 2832 | 20934 | 20949 | GTCTTTGGGATTCTAT | 35 | 2335 |
| 881405 | 2851 | 2866 | 20968 | 20983 | AATGTAAGTGATAGGT | 20 | 2336 |
| 881429 | 3024 | 3039 | 21141 | 21156 | TACTAGGTGCTTGTTG | 51 | 2337 |
| 881453 | 3256 | 3271 | 21373 | 21388 | GTGGACACTTTTAGAG | 48 | 2338 |
| 881477 | 3400 | 3415 | 21517 | 21532 | AGCAGAACGAGGTAAA | 30 | 2339 |

TABLE 33-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881501 | 3500 | 3515 | 21617 | 21632 | AAACACAGTCTGCTGC | 65 | 2340 |
| 881524 | 3612 | 3627 | 21729 | 21744 | AGGTAAGGGCCCCGTG | 53 | 2341 |
| 881548 | 3836 | 3851 | 21953 | 21968 | AAAGGAGGTAGTGGCC | 79 | 2342 |
| 881572 | 4022 | 4037 | 22139 | 22154 | TAAATTCTAGTTTGCC | 32 | 2343 |
| 881591 | 4258 | 4273 | 22375 | 22390 | CGCTCAGGACTCAGGG | 45 | 2344 |
| 881615 | 4390 | 4405 | 22507 | 22522 | GGTAACAATACTGTAA | 41 | 2345 |
| 881639 | 4525 | 4540 | 22642 | 22657 | TGGCGGAGCATCAACA | 63 | 2346 |
| 881663 | 4596 | 4611 | 22713 | 22728 | GAACGGAAGTTTACAC | 33 | 2347 |
| 881687 | 4817 | 4832 | 22934 | 22949 | TCCACCTGCATCGAGA | 53 | 2348 |
| 881711 | 4997 | 5012 | 23114 | 23129 | TTGAAGCAACACGGGA | 39 | 2349 |
| 881735 | 5202 | 5217 | 23319 | 23334 | CATAGCATTATCTACC | 57 | 2350 |
| 881759 | N/A | N/A | 18772 | 18787 | TTAAGCTAAACTCCTA | 90 | 2351 |
| 881783 | N/A | N/A | 18840 | 18855 | GCATCTAAGGCAAGCT | 66 | 2352 |
| 881806 | N/A | N/A | 4006 | 4021 | AGCCAAGGAGGCGGGC | 101 | 2353 |
| 881828 | N/A | N/A | 4334 | 4349 | CGCCAGGCCGGCTAGG | 90 | 2354 |
| 881851 | N/A | N/A | 4636 | 4651 | GCGGAGGACCTCGCCT | 92 | 2355 |
| 881875 | N/A | N/A | 4942 | 4957 | CCCCGGAAGAAGGCAC | 64 | 2356 |
| 881899 | N/A | N/A | 5654 | 5669 | ACGAACGCGCAAAACC | 94 | 2357 |
| 881922 | N/A | N/A | 5769 | 5784 | AGCCGCCGGCACAGGC | 99 | 2358 |
| 881943 | N/A | N/A | 6048 | 6063 | GGTAAACTGCCTTAGG | 75 | 2359 |
| 881967 | N/A | N/A | 6371 | 6386 | TGAAAGACCCCAGCTA | 96 | 2360 |
| 881989 | N/A | N/A | 7080 | 7095 | CTAGAAAGTGATGCTC | 61 | 2361 |
| 882013 | N/A | N/A | 7332 | 7347 | CACTAAAGACTATTAG | 95 | 2362 |
| 882037 | N/A | N/A | 7631 | 7646 | TTGTACAGGACAGGTA | 72 | 2363 |
| 882061 | N/A | N/A | 8109 | 8124 | ATCCACACCAATGGCA | 66 | 2364 |
| 882108 | N/A | N/A | 8494 | 8509 | AGGGAATCCCTTATTA | 94 | 2365 |
| 882132 | N/A | N/A | 9317 | 9332 | GGACAGACCAGGATTC | 75 | 2366 |
| 882154 | N/A | N/A | 9580 | 9595 | TCAATAATCTCCCAGC | 45 | 2367 |
| 882178 | N/A | N/A | 9853 | 9868 | GCCTGAGTTACCGCAT | 30 | 2368 |
| 882201 | N/A | N/A | 10122 | 10137 | TACCATATTGGAAACC | 52 | 2369 |
| 882225 | N/A | N/A | 10283 | 10298 | TTTACTGTTACCGATG | 52 | 2370 |
| 882249 | N/A | N/A | 10608 | 10623 | GAGAAACGAGCCAGTG | 61 | 2371 |
| 882273 | N/A | N/A | 11048 | 11063 | ATCTACTCCAGACCCC | 73 | 2372 |
| 882297 | N/A | N/A | 11324 | 11339 | GGCTCAACCTGGAAGG | 71 | 2373 |
| 882321 | N/A | N/A | 11552 | 11567 | CCTAGAGGTGCCTTCT | 59 | 2374 |
| 882345 | N/A | N/A | 11846 | 11861 | TACTCACGAGCACCTC | 59 | 2375 |

TABLE 33-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882369 | N/A | N/A | 12114 | 12129 | TGCTTCAACACACTGT | 97 | 2376 |
| 882393 | N/A | N/A | 12432 | 12447 | TAAACAAGATGAATCC | 56 | 2377 |
| 882416 | N/A | N/A | 12875 | 12890 | AAGAAGCAAGTCGGTC | 45 | 2378 |
| 882439 | N/A | N/A | 13162 | 13177 | GTCTAAACCAGCATAT | 81 | 2379 |
| 882461 | N/A | N/A | 13783 | 13798 | CAGATAACGAGGTGCC | 70 | 2380 |
| 882483 | N/A | N/A | 14086 | 14101 | GAAAAGAGCCGCCACA | 93 | 2381 |
| 882506 | N/A | N/A | 14331 | 14346 | GCTGAATTGTCATGAA | 64 | 2382 |
| 882553 | N/A | N/A | 15369 | 15384 | TGGCACCAAGGTCCAG | 99 | 2383 |
| 882576 | N/A | N/A | 15776 | 15791 | TCCTTAATTATGCAGA | 56 | 2384 |
| 882600 | N/A | N/A | 15895 | 15910 | ATTCACACTGCCGTGA | 66 | 2385 |
| 882623 | N/A | N/A | 16152 | 16167 | AAACGAGTTGACACAG | 80 | 2386 |
| 882670 | N/A | N/A | 16646 | 16661 | CAATTTATGCCATGGA | 38 | 2387 |
| 882694 | N/A | N/A | 16838 | 16853 | TAGCATGTATGCATTC | 48 | 2388 |
| 882718 | N/A | N/A | 17150 | 17165 | AGCCACTATGGTAGGA | 57 | 2389 |
| 882742 | N/A | N/A | 17471 | 17486 | ATCTTAACCTGGAGAA | 72 | 2390 |
| 882766 | N/A | N/A | 17703 | 17718 | TAGAGAACATTACGAG | 40 | 2391 |
| 882790 | N/A | N/A | 17976 | 17991 | CTAGAACATGATGAGA | 71 | 2392 |
| 882837 | N/A | N/A | 18921 | 18936 | TTATACTGTCTGGTTA | 56 | 2393 |
| 882860 | N/A | N/A | 19205 | 19220 | TTTCAAATCGACTGCC | 69 | 2394 |
| 882884 | N/A | N/A | 19400 | 19415 | TGCAACTGGCTCACTA | 83 | 2395 |
| 882900 | N/A | N/A | 8350 | 8365 | TCATATGGCTAAACCT | 51 | 2396 |
| 882911 | N/A | N/A | 14672 | 14687 | CAAAAACTTGGGTCAC | 80 | 2397 |
| 882914 | N/A | N/A | 16378 | 16393 | GTAACTTGACTTGAGA | 51 | 2398 |
| 882915 | N/A | N/A | 18567 | 18582 | AGCTGAGCTGATCATC | 44 | 2399 |

TABLE 34

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 24 | 195 |
| 881096 | 328 | 343 | 5355 | 5370 | CCTTGAAGAGCGCGGC | 76 | 2400 |
| 881119 | 594 | 609 | 7912 | 7927 | GAGCGAAGGGTAAGGC | 62 | 2401 |
| 881166 | 1121 | 1136 | 13674 | 13689 | TCCCAGTAGATCCTGC | 60 | 2402 |
| 881190 | 1354 | 1369 | 19471 | 19486 | AATATAGTTGTCTGGC | 50 | 2403 |
| 881214 | 1732 | 1747 | 19849 | 19864 | GGGCAGTCAATTGGAC | 75 | 2404 |
| 881238 | 1903 | 1918 | 20020 | 20035 | GATCATCAATGATGGC | 37 | 2405 |

TABLE 34-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881262 | 2033 | 2048 | 20150 | 20165 | AGTCATCACTCTAGTC | 47 | 2406 |
| 881286 | 2189 | 2204 | 20306 | 20321 | GGCACGGCTTCAGTCA | 25 | 2407 |
| 881310 | 2366 | 2381 | 20483 | 20498 | CAAAAATGTCCCATCC | 81 | 2408 |
| 881334 | 2471 | 2486 | 20588 | 20603 | TTCTTTATGCGAAGAA | 91 | 2409 |
| 881358 | 2609 | 2624 | 20726 | 20741 | CTTTAGTGTCGCCATG | 71 | 2410 |
| 881382 | 2822 | 2837 | 20939 | 20954 | TGGAGGTCTTTGGGAT | 42 | 2411 |
| 881406 | 2882 | 2897 | 20999 | 21014 | GTCTACTGCTGTACTT | 48 | 2412 |
| 881430 | 3025 | 3040 | 21142 | 21157 | TTACTAGGTGCTTGTT | 50 | 2413 |
| 881454 | 3258 | 3273 | 21375 | 21390 | TTGTGGACACTTTTAG | 51 | 2414 |
| 881478 | 3401 | 3416 | 21518 | 21533 | GAGCAGAACGAGGTAA | 45 | 2415 |
| 881502 | 3502 | 3517 | 21619 | 21634 | CGAAACACAGTCTGCT | 47 | 2416 |
| 881525 | 3616 | 3631 | 21733 | 21748 | TCACAGGTAAGGGCCC | 53 | 2417 |
| 881549 | 3837 | 3852 | 21954 | 21969 | GAAAGGAGGTAGTGGC | 77 | 2418 |
| 881573 | 4023 | 4038 | 22140 | 22155 | CTAAATTCTAGTTTGC | 79 | 2419 |
| 881592 | 4276 | 4291 | 22393 | 22408 | GACTAACTCTCCTGTT | 83 | 2420 |
| 881616 | 4391 | 4406 | 22508 | 22523 | TGGTAACAATACTGTA | 35 | 2421 |
| 881640 | 4533 | 4548 | 22650 | 22665 | GGCCTTCCTGGCGGAG | 78 | 2422 |
| 881664 | 4598 | 4613 | 22715 | 22730 | ATGAACGGAAGTTTAC | 46 | 2423 |
| 881688 | 4828 | 4843 | 22945 | 22960 | TCTCAAGGAGATCCAC | 99 | 2424 |
| 881712 | 4998 | 5013 | 23115 | 23130 | TTTGAAGCAACACGGG | 53 | 2425 |
| 881736 | 5203 | 5218 | 23320 | 23335 | GCATAGCATTATCTAC | 49 | 2426 |
| 881760 | N/A | N/A | 18774 | 18789 | ACTTAAGCTAAACTCC | 79 | 2427 |
| 881784 | N/A | N/A | 18841 | 18856 | AGCATCTAAGGCAAGC | 43 | 2428 |
| 881807 | N/A | N/A | 4042 | 4057 | CAGGAGCGCGGAGGGC | 89 | 2429 |
| 881829 | N/A | N/A | 4367 | 4382 | ACGACAGCTGCGGAGC | 73 | 2430 |
| 881852 | N/A | N/A | 4638 | 4653 | GCGCGGAGGACCTCGC | 90 | 2431 |
| 881876 | N/A | N/A | 5008 | 5023 | GACCACGAGGCCCCGG | 69 | 2432 |
| 881900 | N/A | N/A | 5656 | 5671 | GGACGAACGCGCAAAA | 65 | 2433 |
| 881923 | N/A | N/A | 5773 | 5788 | AAACAGCCGCCGGCAC | 89 | 2434 |
| 881944 | N/A | N/A | 6117 | 6132 | TCCCGGAGGAAGTCCC | 70 | 2435 |
| 881968 | N/A | N/A | 6377 | 6392 | GTAAACTGAAAGACCC | 65 | 2436 |
| 881990 | N/A | N/A | 7152 | 7167 | CATAACTCAGGCAAGG | 64 | 2437 |
| 882014 | N/A | N/A | 7335 | 7350 | ACTCACTAAAGACTAT | 82 | 2438 |
| 882038 | N/A | N/A | 7645 | 7660 | CTACAAGGTCTGAGTT | 83 | 2439 |
| 882062 | N/A | N/A | 8116 | 8131 | ACTTAAAATCCACACC | 93 | 2440 |
| 882085 | N/A | N/A | 8366 | 8381 | TTTATGTAAAGCTTCG | 25 | 2441 |

TABLE 34-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882109 | N/A | N/A | 8498 | 8513 | CCTCAGGGAATCCCTT | 70 | 2442 |
| 882133 | N/A | N/A | 9340 | 9355 | GGAAAGAGCTTTGGTG | 88 | 2443 |
| 882155 | N/A | N/A | 9581 | 9596 | CTCAATAATCTCCCAG | 47 | 2444 |
| 882179 | N/A | N/A | 9877 | 9892 | GTAACTAACTCAAAAG | 101 | 2445 |
| 882202 | N/A | N/A | 10125 | 10140 | CACTACCATATTGGAA | 78 | 2446 |
| 882226 | N/A | N/A | 10284 | 10299 | ATTTACTGTTACCGAT | 71 | 2447 |
| 882250 | N/A | N/A | 10609 | 10624 | GGAGAAACGAGCCAGT | 53 | 2448 |
| 882274 | N/A | N/A | 11052 | 11067 | CTACATCTACTCCAGA | 78 | 2449 |
| 882298 | N/A | N/A | 11332 | 11347 | TTATTTGTGGCTCAAC | 82 | 2450 |
| 882322 | N/A | N/A | 11554 | 11569 | AGCCTAGAGGTGCCTT | 59 | 2451 |
| 882346 | N/A | N/A | 11859 | 11874 | GGGCATCCTCAGTTAC | 67 | 2452 |
| 882370 | N/A | N/A | 12138 | 12153 | ACCCACATCACTGTCT | 85 | 2453 |
| 882394 | N/A | N/A | 12456 | 12471 | CTAAAACTGCGCTCTC | 76 | 2454 |
| 882417 | N/A | N/A | 12878 | 12893 | AGAAAGAAGCAAGTCG | 63 | 2455 |
| 882440 | N/A | N/A | 13169 | 13184 | TTAATCTGTCTAAACC | 84 | 2456 |
| 882462 | N/A | N/A | 13784 | 13799 | ACAGATAACGAGGTGC | 70 | 2457 |
| 882484 | N/A | N/A | 14116 | 14131 | TTCCAACCTTTATGAT | 93 | 2458 |
| 882507 | N/A | N/A | 14335 | 14350 | GTTCGCTGAATTGTCA | 63 | 2459 |
| 882530 | N/A | N/A | 14674 | 14689 | TACAAAACTTGGGTC | 91 | 2460 |
| 882554 | N/A | N/A | 15406 | 15421 | TAGAAAGCCCTCACCT | 95 | 2461 |
| 882577 | N/A | N/A | 15781 | 15796 | GGGAATCCTTAATTAT | 88 | 2462 |
| 882601 | N/A | N/A | 15898 | 15913 | TACATTCACACTGCCG | 42 | 2463 |
| 882624 | N/A | N/A | 16154 | 16169 | AGAAACGAGTTGACAC | 85 | 2464 |
| 882647 | N/A | N/A | 16380 | 16395 | CAGTAACTTGACTTGA | 61 | 2465 |
| 882671 | N/A | N/A | 16647 | 16662 | CCAATTTATGCCATGG | 88 | 2466 |
| 882695 | N/A | N/A | 16857 | 16872 | GAACATCTCAGATACA | 58 | 2467 |
| 882719 | N/A | N/A | 17158 | 17173 | GAACAGGAAGCCACTA | 77 | 2468 |
| 882743 | N/A | N/A | 17481 | 17496 | TCTTACAGCAATCTTA | 68 | 2469 |
| 882767 | N/A | N/A | 17709 | 17724 | CTATGCTAGAGAACAT | 77 | 2470 |
| 882791 | N/A | N/A | 17977 | 17992 | GCTAGAACATGATGAG | 86 | 2471 |
| 882814 | N/A | N/A | 18570 | 18585 | GATAGCTGAGCTGATC | 68 | 2472 |
| 882838 | N/A | N/A | 18923 | 18938 | ATTTATACTGTCTGGT | 51 | 2473 |
| 882861 | N/A | N/A | 19211 | 19226 | TGTTACTTTCAAATCG | 52 | 2474 |
| 882885 | N/A | N/A | 19401 | 19416 | CTGCAACTGGCTCACT | 90 | 2475 |

TABLE 35

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 12 | 195 |
| 881097 | 329 | 344 | N/A | N/A | GCCTTGAAGAGCGCGG | 91 | 2476 |
| 881120 | 613 | 628 | N/A | N/A | TGTGAACCTGCTGGGC | 98 | 2477 |
| 881167 | 1189 | 1204 | 13742 | 13757 | CAAAGAGCTTGCAGGT | 96 | 2478 |
| 881191 | 1355 | 1370 | 19472 | 19487 | TAATATAGTTGTCTGG | 60 | 2479 |
| 881215 | 1738 | 1753 | 19855 | 19870 | GTAAGAGGGCAGTCAA | 56 | 2480 |
| 881239 | 1910 | 1925 | 20027 | 20042 | TCACAGTGATCATCAA | 57 | 2481 |
| 881263 | 2040 | 2055 | 20157 | 20172 | TACAAGCAGTCATCAC | 71 | 2482 |
| 881287 | 2190 | 2205 | 20307 | 20322 | AGGCACGGCTTCAGTC | 51 | 2483 |
| 881311 | 2382 | 2397 | 20499 | 20514 | TAGATTGTAGGACAGA | 72 | 2484 |
| 881335 | 2472 | 2487 | 20589 | 20604 | CTTCTTTATGCGAAGA | 105 | 2485 |
| 881359 | 2610 | 2625 | 20727 | 20742 | CCTTTAGTGTCGCCAT | 42 | 2486 |
| 881383 | 2824 | 2839 | 20941 | 20956 | AGTGGAGGTCTTTGGG | 45 | 2487 |
| 881407 | 2887 | 2902 | 21004 | 21019 | CCCCAGTCTACTGCTG | 53 | 2488 |
| 881431 | 3026 | 3041 | 21143 | 21158 | CTTACTAGGTGCTTGT | 62 | 2489 |
| 881455 | 3270 | 3285 | 21387 | 21402 | AAACACCCCTTCTTGT | 113 | 2490 |
| 881479 | 3404 | 3419 | 21521 | 21536 | TCTGAGCAGAACGAGG | 53 | 2491 |
| 881503 | 3503 | 3518 | 21620 | 21635 | ACGAAACACAGTCTGC | 48 | 2492 |
| 881526 | 3618 | 3633 | 21735 | 21750 | GGTCACAGGTAAGGGC | 75 | 2493 |
| 881550 | 3896 | 3911 | 22013 | 22028 | TCATACCCTGGATCAC | 57 | 2494 |
| 881574 | 4039 | 4054 | 22156 | 22171 | GTCCACTGAGTACAAA | 87 | 2495 |
| 881593 | 4278 | 4293 | 22395 | 22410 | GCGACTAACTCTCCTG | 30 | 2496 |
| 881617 | 4410 | 4425 | 22527 | 22542 | AATACCTACCTGCCCT | 85 | 2497 |
| 881641 | 4540 | 4555 | 22657 | 22672 | CACAAGTGGCCTTCCT | 55 | 2498 |
| 881665 | 4600 | 4615 | 22717 | 22732 | CAATGAACGGAAGTTT | 67 | 2499 |
| 881689 | 4837 | 4852 | 22954 | 22969 | CTATCAGGATCTCAAG | 91 | 2500 |
| 881713 | 5020 | 5035 | 23137 | 23152 | TGTTAAGTCCCATCTG | 75 | 2501 |
| 881737 | 5204 | 5219 | 23321 | 23336 | AGCATAGCATTATCTA | 66 | 2502 |
| 881761 | N/A | N/A | 18775 | 18790 | GACTTAAGCTAAACTC | 42 | 2503 |
| 881785 | N/A | N/A | 18842 | 18857 | CAGCATCTAAGGCAAG | 46 | 2504 |
| 881830 | N/A | N/A | 4368 | 4383 | GACGACAGCTGCGGAG | 55 | 2505 |
| 881853 | N/A | N/A | 4640 | 4655 | ACGCGCGGAGGACCTC | 87 | 2506 |
| 881877 | N/A | N/A | 5011 | 5026 | AGTGACCACGAGGCCC | 85 | 2507 |
| 881901 | N/A | N/A | 5657 | 5672 | CGGACGAACGCGCAAA | 61 | 2508 |
| 881924 | N/A | N/A | 5775 | 5790 | GAAAACAGCCGCCGGC | 74 | 2509 |
| 881945 | N/A | N/A | 6122 | 6137 | CAAATTCCCGGAGGAA | 95 | 2510 |
| 881969 | N/A | N/A | 6378 | 6393 | CGTAAACTGAAAGACC | 52 | 2511 |

TABLE 35-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881991 | N/A | N/A | 7153 | 7168 | ACATAACTCAGGCAAG | 99 | 2512 |
| 882015 | N/A | N/A | 7345 | 7360 | CAAAATAGTCACTCAC | 103 | 2513 |
| 882039 | N/A | N/A | 7646 | 7661 | TCTACAAGGTCTGAGT | 43 | 2514 |
| 882063 | N/A | N/A | 8119 | 8134 | CCAACTTAAAATCCAC | 91 | 2515 |
| 882086 | N/A | N/A | 8380 | 8395 | GATACTTGTACTGTTT | 22 | 2516 |
| 882110 | N/A | N/A | 8546 9066 | 8561 9081 | AAGAAGCACTGGCATT | 78 | 2517 |
| 882134 | N/A | N/A | 9341 | 9356 | GGGAAAGAGCTTTGGT | 95 | 2518 |
| 882156 | N/A | N/A | 9592 | 9607 | AAATATACCAGCTCAA | 75 | 2519 |
| 882180 | N/A | N/A | 9921 | 9936 | CCAAGGGTTCAGTGT | 74 | 2520 |
| 882203 | N/A | N/A | 10128 | 10143 | CTCCACTACCATATTG | 99 | 2521 |
| 882227 | N/A | N/A | 10285 | 10300 | CATTTACTGTTACCGA | 21 | 2522 |
| 882251 | N/A | N/A | 10610 | 10625 | TGGAGAAACGAGCCAG | 62 | 2523 |
| 882275 | N/A | N/A | 11054 | 11069 | GTCTACATCTACTCCA | 62 | 2524 |
| 882299 | N/A | N/A | 11333 | 11348 | CTTATTTGTGGCTCAA | 45 | 2525 |
| 882323 | N/A | N/A | 11655 | 11670 | ACCTTAAGCTATTTGG | 39 | 2526 |
| 882347 | N/A | N/A | 11865 | 11880 | CCCAAAGGGCATCCTC | 59 | 2527 |
| 882371 | N/A | N/A | 12143 | 12158 | ACTTAACCCACATCAC | 122 | 2528 |
| 882395 | N/A | N/A | 12484 | 12499 | GGCTTTGTGTTTAAGT | 77 | 2529 |
| 882418 | N/A | N/A | 12890 | 12905 | TAACGGTGTTTCAGAA | 74 | 2530 |
| 882441 | N/A | N/A | 13173 | 13188 | CCATTTAATCTGTCTA | 72 | 2531 |
| 882463 | N/A | N/A | 13785 | 13800 | AACAGATAACGAGGTG | 104 | 2532 |
| 882485 | N/A | N/A | 14124 | 14139 | CAATATGCTTCCAACC | 115 | 2533 |
| 882508 | N/A | N/A | 14343 | 14358 | AGCCAGAGGTTCGCTG | 75 | 2534 |
| 882531 | N/A | N/A | 14677 | 14692 | GCTTACAAAAACTTGG | 74 | 2535 |
| 882555 | N/A | N/A | 15407 | 15422 | TTAGAAAGCCCTCACC | 116 | 2536 |
| 882578 | N/A | N/A | 15782 | 15797 | TGGGAATCCTTAATTA | 88 | 2537 |
| 882625 | N/A | N/A | 16155 | 16170 | AAGAAACGAGTTGACA | 78 | 2538 |
| 882648 | N/A | N/A | 16385 | 16400 | TGGAACAGTAACTTGA | 88 | 2539 |
| 882672 | N/A | N/A | 16648 | 16663 | ACCAATTTATGCCATG | 83 | 2540 |
| 882696 | N/A | N/A | 16860 | 16875 | TGTGAACATCTCAGAT | 88 | 2541 |
| 882720 | N/A | N/A | 17170 | 17185 | GGCCTTTACAAAGAAC | 119 | 2542 |
| 882744 | N/A | N/A | 17487 | 17502 | TAGCATTCTTACAGCA | 43 | 2543 |
| 882768 | N/A | N/A | 17726 | 17741 | GTTGAACCCATCTTGA | 84 | 2544 |
| 882792 | N/A | N/A | 17978 | 17993 | AGCTAGAACATGATGA | 95 | 2545 |
| 882815 | N/A | N/A | 18571 | 18586 | TGATAGCTGAGCTGAT | 63 | 2546 |
| 882839 | N/A | N/A | 18939 | 18954 | AGCTAACTGGCCTCAA | 77 | 2547 |

TABLE 35-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882862 | N/A | N/A | 19221 | 19236 | GGGTTAAAGATGTTAC | 50 | 2548 |
| 882886 | N/A | N/A | 19408 | 19423 | AGATATCCTGCAACTG | 109 | 2549 |
| 882891 | N/A | N/A | 4045 | 4060 | TCGCAGGAGCGCGGAG | 137 | 2550 |
| 882913 | N/A | N/A | 15899 | 15914 | ATACATTCACACTGCC | 55 | 2551 |

TABLE 36

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 26 | 195 |
| 881098 | 335 | 350 | N/A | N/A | GCCCAAGCCTTGAAGA | 85 | 2552 |
| 881121 | 620 | 635 | 9110 | 9125 | ATGTAGTTGTGAACCT | 61 | 2553 |
| 881168 | 1191 | 1206 | 13744 | 13759 | GTCAAAGAGCTTGCAG | 56 | 2554 |
| 881192 | 1356 | 1371 | 19473 | 19488 | ATAATATAGTTGTCTG | 65 | 2555 |
| 881216 | 1739 | 1754 | 19856 | 19871 | AGTAAGAGGGCAGTCA | 50 | 2556 |
| 881240 | 1919 | 1934 | 20036 | 20051 | GGTCAATTTTCACAGT | 36 | 2557 |
| 881264 | 2041 | 2056 | 20158 | 20173 | CTACAAGCAGTCATCA | 56 | 2558 |
| 881288 | 2192 | 2207 | 20309 | 20324 | ACAGGCACGGCTTCAG | 36 | 2559 |
| 881312 | 2384 | 2399 | 20501 | 20516 | ACTAGATTGTAGGACA | 109 | 2560 |
| 881336 | 2507 | 2522 | 20624 | 20639 | GTTCAAGTATTAAGAT | 71 | 2561 |
| 881360 | 2611 | 2626 | 20728 | 20743 | TCCTTTAGTGTCGCCA | 24 | 2562 |
| 881384 | 2825 | 2840 | 20942 | 20957 | AAGTGGAGGTCTTTGG | 34 | 2563 |
| 881432 | 3043 | 3058 | 21160 | 21175 | TAGGGATACAGCAGGC | 27 | 2564 |
| 881456 | 3272 | 3287 | 21389 | 21404 | ATAAACACCCCTTCTT | 70 | 2565 |
| 881480 | 3408 | 3423 | 21525 | 21540 | GGCCTCTGAGCAGAAC | 73 | 2566 |
| 881504 | 3504 | 3519 | 21621 | 21636 | CACGAAACACAGTCTG | 48 | 2567 |
| 881527 | 3624 | 3639 | 21741 | 21756 | AAAGAGGGTCACAGGT | 66 | 2568 |
| 881551 | 3898 | 3913 | 22015 | 22030 | GGTCATACCCTGGATC | 51 | 2569 |
| 881575 | 4051 | 4066 | 22168 | 22183 | TTCAACAGCACTGTCC | 35 | 2570 |
| 881594 | 4284 | 4299 | 22401 | 22416 | TGTAGGGCGACTAACT | 79 | 2571 |
| 881618 | 4411 | 4426 | 22528 | 22543 | TAATACCTACCTGCCC | 96 | 2572 |
| 881642 | 4543 | 4558 | 22660 | 22675 | ACACACAAGTGGCCTT | 56 | 2573 |
| 881666 | 4601 | 4616 | 22718 | 22733 | GCAATGAACGGAAGTT | 55 | 2574 |
| 881690 | 4838 | 4853 | 22955 | 22970 | GCTATCAGGATCTCAA | 62 | 2575 |
| 881714 | 5021 | 5036 | 23138 | 23153 | CTGTTAAGTCCCATCT | 46 | 2576 |

TABLE 36-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 881738 | 5205 | 5220 | 23322 | 23337 | CAGCATAGCATTATCT | 151 | 2577 |
| 881762 | N/A | N/A | 18777 | 18792 | ACGACTTAAGCTAAAC | 42 | 2578 |
| 881786 | N/A | N/A | 18846 | 18861 | TTTACAGCATCTAAGG | 66 | 2579 |
| 881808 | N/A | N/A | 4055 | 4070 | GGCGACCCCGTCGCAG | 70 | 2580 |
| 881831 | N/A | N/A | 4372 | 4387 | GGGCGACGACAGCTGC | 68 | 2581 |
| 881854 | N/A | N/A | 4642 | 4657 | CCACGCGCGGAGGACC | 81 | 2582 |
| 881878 | N/A | N/A | 5015 | 5030 | CGCCAGTGACCACGAG | 58 | 2583 |
| 881902 | N/A | N/A | 5659 | 5674 | CACGGACGAACGCGCA | 102 | 2584 |
| 881946 | N/A | N/A | 6124 | 6139 | ACCAAATTCCCGGAGG | 93 | 2585 |
| 881970 | N/A | N/A | 6413 | 6428 | GCATAGGTCCTTCAGA | 69 | 2586 |
| 881992 | N/A | N/A | 7154 | 7169 | CACATAACTCAGGCAA | 63 | 2587 |
| 882016 | N/A | N/A | 7347 | 7362 | TGCAAAATAGTCACTC | 52 | 2588 |
| 882040 | N/A | N/A | 7647 | 7662 | TTCTACAAGGTCTGAG | 53 | 2589 |
| 882064 | N/A | N/A | 8139 | 8154 | GCGGACACGCCCGACC | 85 | 2590 |
| 882087 | N/A | N/A | 8383 | 8398 | GGAGATACTTGTACTG | 34 | 2591 |
| 882111 | N/A | N/A | 8550 8706 8810 8966 9070 | 8565 8721 8825 8981 9085 | AGATAAGAAGCACTGG | 75 | 2592 |
| 882157 | N/A | N/A | 9593 | 9608 | GAAATATACCAGCTCA | 39 | 2593 |
| 882181 | N/A | N/A | 9957 | 9972 | GGCCAAATTGCAAAGG | 52 | 2594 |
| 882204 | N/A | N/A | 10149 | 10164 | TAGTTTTATGTTAGCC | 25 | 2595 |
| 882228 | N/A | N/A | 10287 | 10302 | TTCATTTACTGTTACC | 29 | 2596 |
| 882252 | N/A | N/A | 10615 | 10630 | GCTGATGGAGAAACGA | 93 | 2597 |
| 882276 | N/A | N/A | 11087 | 11102 | TAAATCACCCTGGTCA | 78 | 2598 |
| 882300 | N/A | N/A | 11347 | 11362 | GTAGAGGAGGAGGACT | 84 | 2599 |
| 882324 | N/A | N/A | 11660 | 11675 | TCCAAACCTTAAGCTA | 63 | 2600 |
| 882348 | N/A | N/A | 11891 | 11906 | AGCCTTCCTGCTCAGA | 45 | 2601 |
| 882372 | N/A | N/A | 12144 | 12159 | GACTTAACCCACATCA | 266 | 2602 |
| 882396 | N/A | N/A | 12492 | 12507 | TCCCACTGGGCTTTGT | 68 | 2603 |
| 882419 | N/A | N/A | 12891 | 12906 | ATAACGGTGTTTCAGA | 53 | 2604 |
| 882442 | N/A | N/A | 13174 | 13189 | CCCATTTAATCTGTCT | 67 | 2605 |
| 882464 | N/A | N/A | 13787 | 13802 | CTAACAGATAACGAGG | 77 | 2606 |
| 882486 | N/A | N/A | 14129 | 14144 | GTTAACAATATGCTTC | 75 | 2607 |

TABLE 36-continued

Percent control of human IRF4 mRNA with 3-10-3 cEt gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 882509 | N/A | N/A | 14347 | 14362 | AGCCAGCCAGAGGTTC | 70 | 2608 |
| 882532 | N/A | N/A | 14691 | 14706 | GAAAATCTGGATGAGC | 36 | 2609 |
| 882556 | N/A | N/A | 15437 | 15452 | AGCCAGTGCCAGTTCC | 61 | 2610 |
| 882579 | N/A | N/A | 15803 | 15818 | AGATAACATGAGAGTG | 59 | 2611 |
| 882602 | N/A | N/A | 15923 | 15938 | AATGACTTAGTCAGAA | 73 | 2612 |
| 882626 | N/A | N/A | 16159 | 16174 | GCAAAAGAAACGAGTT | 92 | 2613 |
| 882649 | N/A | N/A | 16387 | 16402 | GATGGAACAGTAACTT | 49 | 2614 |
| 882673 | N/A | N/A | 16663 | 16678 | ACGCAATGGCAAAAGA | 89 | 2615 |
| 882697 | N/A | N/A | 16887 | 16902 | TCTTACTCCGCTGAGT | 65 | 2616 |
| 882721 | N/A | N/A | 17224 | 17239 | TTCCAGGTCATTTGAC | 34 | 2617 |
| 882745 | N/A | N/A | 17492 | 17507 | CTAGATAGCATTCTTA | 61 | 2618 |
| 882769 | N/A | N/A | 17731 | 17746 | CCACAGTTGAACCCAT | 64 | 2619 |
| 882793 | N/A | N/A | 17982 | 17997 | TCAGAGCTAGAACATG | 62 | 2620 |
| 882816 | N/A | N/A | 18579 | 18594 | GATTGATGTGATAGCT | 44 | 2621 |
| 882840 | N/A | N/A | 18960 | 18975 | CTACTATTGTGGAAAA | 97 | 2622 |
| 882863 | N/A | N/A | 19230 | 19245 | CTTAATTCTGGGTTAA | 47 | 2623 |
| 882887 | N/A | N/A | 19417 | 19432 | ACATTACTGAGATATC | 84 | 2624 |
| 882895 | N/A | N/A | 5776 | 5791 | CGAAAACAGCCGCCGG | 85 | 2625 |
| 882901 | N/A | N/A | 9358 | 9373 | ACGCAGCCTCTAAGAA | 75 | 2626 |

Example 7: Effect of Mixed MOE and cEt Gapmers with Phosphorothioate Internucleoside Linkages on Human IRF4 In Vitro, Single Dose Modified oligonucleotides complementary to a human IRF4 nucleic acid were designed and tested for their effect on IRF4 mRNA in vitro.

Cultured MM.1R cells at a density of 5,000 cells per well were transfected by free uptake with 1,000 nM concentration of modified oligonucleotide or no modified oligonucleotide for untreated controls. After approximately 24 hours, RNA was isolated from the cells and IRF4 mRNA levels were measured by quantitative real-time PCR. Human primer probe set hIRF4_LTS34726 (forward sequence GGCAAAGAAAGCTCATCACAG, designated herein as SEQ ID NO: 3389; reverse sequence GGATTGCTGATGTGTTCTGGTA designated herein as SEQ ID NO: 3390; probe sequence TAGCCCCTCAGGAAATGTCCACTG, designated herein as SEQ ID: 3391) was used to measure mRNA levels. IRF4 mRNA levels were adjusted according to total RNA content, as measured by RIBOGREEN®. Results are presented in the table below as percent control of the amount of IRF4 mRNA, relative to untreated control (UTC) cells.

The modified oligonucleotides in Table 37 are cEt and/or MOE containing gapmers. The modified oligonucleotides have a central gap segment comprising 2'-deoxynucleosides which is flanked by wing segments on the 5' direction and the 3' direction. At least one nucleoside in the 5' wing segment and/or one nucleoside in the 3' wing segment has a MOE and/or cEt sugar modification. The "Motif" column describes the sugar modifications of each oligonucleotide. "k" indicates a cEt sugar modification; "d" indicates deoxyribose; and "e" indicates a MOE modification. Each internucleoside linkage is a phosphorothioate internucleoside linkage and each cytosine residue is a 5-methylcytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Table 37 below is complementary to human IRF4 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to human IRF4 reduced the amount of human IRF4 mRNA.

TABLE 37

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 881450 | 3252 | 3267 | 21369 | 21384 | ACACTTTTAGAGAGGA | kkk-d10-kkk | 47 | 2111 |
| 881659 | 4592 | 4607 | 22709 | 22724 | GGAAGTTTACACTGGA | kkk-d10-kkk | 15 | 2044 |
| 935895 | 4200 | 4215 | 22317 | 22332 | TCTATAGTGTTCCAGG | kk-d9-eeekk | 50 | 1734 |
| 935896 | 3070 | 3085 | 21187 | 21202 | GCTTGATAAAGGCTGA | kk-d9-eeekk | 72 | 1505 |
| 935897 | 3251 | 3266 | 21368 | 21383 | CACTTTTAGAGAGGAG | kk-d9-eeekk | 67 | 2036 |
| 935898 | 4227 | 4242 | 22344 | 22359 | GTTGTAAATGAGTCGG | kk-d9-eeekk | 18 | 559 |
| 935899 | 4591 | 4606 | 22708 | 22723 | GAAGTTTACACTGGAT | kk-d9-eeekk | 72 | 1968 |
| 935900 | N/A | N/A | 8464 | 8479 | GCATTTTATCATCCGA | kk-d9-eeekk | 62 | 1605 |
| 935901 | N/A | N/A | 11115 | 11130 | GTGATGTCAGGTTTTC | kk-d9-eeekk | 62 | 2627 |
| 935902 | 5186 | 5201 | 23303 | 23318 | TCAGTTTGTGAAGCAT | kk-d9-eeekk | 61 | 649 |
| 935903 | 4171 | 4186 | 22288 | 22303 | TGCTTGAGGTTTTCCT | kk-d9-eeekk | 68 | 548 |
| 935904 | 2914 | 2929 | 21031 | 21046 | AGTATGAGAAACGGCC | kk-d9-eeekk | 84 | 1045 |
| 935905 | 4199 | 4214 | 22316 | 22331 | CTATAGTGTTCCAGGA | kk-d9-eeekk | 66 | 552 |
| 935906 | 3069 | 3084 | 21186 | 21201 | CTTGATAAAGGCTGAA | kk-d9-eeekk | 90 | 1427 |
| 935907 | 3250 | 3265 | 21367 | 21382 | ACTTTTAGAGAGGAGA | kk-d9-eeekk | 64 | 1960 |
| 935908 | 4226 | 4241 | 22343 | 22358 | TTGTAAATGAGTCGGT | kk-d9-eeekk | 52 | 195 |
| 935909 | 4593 | 4608 | 22710 | 22725 | CGGAAGTTTACACTGG | kk-d9-eeekk | 66 | 2119 |
| 935910 | N/A | N/A | 8466 | 8481 | AAGCATTTTATCATCC | kk-d9-eeekk | 79 | 2628 |
| 935911 | N/A | N/A | 11117 | 11132 | CAGTGATGTCAGGTTT | kk-d9-eeekk | 44 | 2629 |
| 935912 | 5188 | 5203 | 23305 | 23320 | CCTCAGTTTGTGAAGC | kk-d9-eeekk | 67 | 1894 |
| 935913 | 4173 | 4188 | 22290 | 22305 | ACTGCTTGAGGTTTTC | kk-d9-eeekk | 55 | 1356 |
| 935914 | 2916 | 2931 | 21033 | 21048 | GTAGTATGAGAAACGG | kk-d9-eeekk | 49 | 426 |
| 935915 | 4201 | 4216 | 22318 | 22333 | CTCTATAGTGTTCCAG | kk-d9-eeekk | 52 | 1811 |
| 935916 | 3071 | 3086 | 21188 | 21203 | AGCTTGATAAAGGCTG | kk-d9-eeekk | 97 | 1579 |
| 935917 | 3252 | 3267 | 21369 | 21384 | ACACTTTTAGAGAGGA | kk-d9-eeekk | 79 | 2111 |
| 935918 | 4228 | 4243 | 22345 | 22360 | AGTTGTAAATGAGTCG | kk-d9-eeekk | 34 | 2021 |
| 935919 | 4594 | 4609 | 22711 | 22726 | ACGGAAGTTTACACTG | kk-d9-eeekk | 85 | 2195 |
| 935920 | N/A | N/A | 8467 | 8482 | GAAGCATTTTATCATC | kk-d9-eeekk | 91 | 2630 |
| 935921 | N/A | N/A | 11118 | 11133 | GCAGTGATGTCAGGTT | kk-d9-eeekk | 19 | 2631 |
| 935922 | 5189 | 5204 | 23306 | 23321 | ACCTCAGTTTGTGAAG | kk-d9-eeekk | 96 | 1971 |
| 935923 | 4174 | 4189 | 22291 | 22306 | TACTGCTTGAGGTTTT | kk-d9-eeekk | 90 | 1433 |
| 935924 | 2917 | 2932 | 21034 | 21049 | TGTAGTATGAGAAACG | kk-d9-eeekk | 93 | 1197 |
| 935925 | 4202 | 4217 | 22319 | 22334 | TCTCTATAGTGTTCCA | kk-d9-eeekk | 43 | 2632 |
| 935926 | 3072 | 3087 | 21189 | 21204 | AAGCTTGATAAAGGCT | kk-d9-eeekk | 47 | 2633 |
| 935927 | 3253 | 3268 | 21370 | 21385 | GACACTTTTAGAGAGG | kk-d9-eeekk | 75 | 451 |
| 935928 | 4229 | 4244 | 22346 | 22361 | CAGTTGTAAATGAGTC | kk-d9-eeekk | 38 | 560 |

TABLE 37-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 935929 | 4592 | 4607 | 22709 | 22724 | GGAAGTTTACACTGGA | kk-d9-ekeke | 36 | 2044 |
| 935930 | N/A | N/A | 8465 | 8480 | AGCATTTTATCATCCG | kk-d9-ekeke | 54 | 1679 |
| 935931 | N/A | N/A | 11116 | 11131 | AGTGATGTCAGGTTTT | kk-d9-ekeke | 67 | 1232 |
| 935932 | 5187 | 5202 | 23304 | 23319 | CTCAGTTTGTGAAGCA | kk-d9-ekeke | 72 | 1817 |
| 935933 | 4172 | 4187 | 22289 | 22304 | CTGCTTGAGGTTTTCC | kk-d9-ekeke | 51 | 1279 |
| 935934 | 2915 | 2930 | 21032 | 21047 | TAGTATGAGAAACGGC | kk-d9-ekeke | 50 | 1121 |
| 935935 | 4200 | 4215 | 22317 | 22332 | TCTATAGTGTTCCAGG | kk-d9-ekeke | 44 | 1734 |
| 935936 | 3070 | 3085 | 21187 | 21202 | GCTTGATAAAGGCTGA | kk-d9-ekeke | 61 | 1505 |
| 935937 | 3251 | 3266 | 21368 | 21383 | CACTTTTAGAGAGGAG | kk-d9-ekeke | 74 | 2036 |
| 935938 | 4227 | 4242 | 22344 | 22359 | GTTGTAAATGAGTCGG | kk-d9-ekeke | 52 | 559 |
| 935939 | 4591 | 4606 | 22708 | 22723 | GAAGTTTACACTGGAT | kk-d9-ekeke | 42 | 1968 |
| 935940 | N/A | N/A | 8464 | 8479 | GCATTTTATCATCCGA | kk-d9-ekeke | 56 | 1605 |
| 935941 | N/A | N/A | 11115 | 11130 | GTGATGTCAGGTTTTC | kk-d9-ekeke | 42 | 2627 |
| 935942 | 5186 | 5201 | 23303 | 23318 | TCAGTTTGTGAAGCAT | kk-d9-ekeke | 55 | 649 |
| 935943 | 4171 | 4186 | 22288 | 22303 | TGCTTGAGGTTTTCCT | kk-d9-ekeke | 55 | 548 |
| 935944 | 2914 | 2929 | 21031 | 21046 | AGTATGAGAAACGGCC | kk-d9-ekeke | 89 | 1045 |
| 935945 | 4199 | 4214 | 22316 | 22331 | CTATAGTGTTCCAGGA | kk-d9-ekeke | 52 | 552 |
| 935946 | 3069 | 3084 | 21186 | 21201 | CTTGATAAAGGCTGAA | kk-d9-ekeke | 81 | 1427 |
| 935947 | 3250 | 3265 | 21367 | 21382 | ACTTTTAGAGAGGAGA | kk-d9-ekeke | 48 | 1960 |
| 935948 | 4226 | 4241 | 22343 | 22358 | TTGTAAATGAGTCGGT | kk-d9-ekeke | 43 | 195 |
| 935949 | 4593 | 4608 | 22710 | 22725 | CGGAAGTTTACACTGG | kk-d9-ekeke | 67 | 2119 |
| 935950 | N/A | N/A | 8466 | 8481 | AAGCATTTTATCATCC | kk-d9-ekeke | 75 | 2628 |
| 935951 | N/A | N/A | 11117 | 11132 | CAGTGATGTCAGGTTT | kk-d9-ekeke | 53 | 2629 |
| 935952 | 5188 | 5203 | 23305 | 23320 | CCTCAGTTTGTGAAGC | kk-d9-ekeke | 79 | 1894 |
| 935953 | 4173 | 4188 | 22290 | 22305 | ACTGCTTGAGGTTTTC | kk-d9-ekeke | 60 | 1356 |
| 935954 | 2916 | 2931 | 21033 | 21048 | GTAGTATGAGAAACGG | kk-d9-ekeke | 65 | 426 |
| 935955 | 4201 | 4216 | 22318 | 22333 | CTCTATAGTGTTCCAG | kk-d9-ekeke | 57 | 1811 |
| 935956 | 3071 | 3086 | 21188 | 21203 | AGCTTGATAAAGGCTG | kk-d9-ekeke | 82 | 1579 |
| 935957 | 3252 | 3267 | 21369 | 21384 | ACACTTTTAGAGAGGA | kk-d9-ekeke | 59 | 2111 |
| 935958 | 4228 | 4243 | 22345 | 22360 | AGTTGTAAATGAGTCG | kk-d9-ekeke | 27 | 2021 |
| 935959 | 4594 | 4609 | 22711 | 22726 | ACGGAAGTTTACACTG | kk-d9-ekeke | 92 | 2195 |
| 935960 | N/A | N/A | 8467 | 8482 | GAAGCATTTTATCATC | kk-d9-ekeke | 94 | 2630 |
| 935961 | N/A | N/A | 11118 | 11133 | GCAGTGATGTCAGGTT | kk-d9-ekeke | 20 | 2631 |
| 935962 | 5189 | 5204 | 23306 | 23321 | ACCTCAGTTTGTGAAG | kk-d9-ekeke | 87 | 1971 |
| 935963 | 4174 | 4189 | 22291 | 22306 | TACTGCTTGAGGTTTT | kk-d9-ekeke | 82 | 1433 |
| 935964 | 2917 | 2932 | 21034 | 21049 | TGTAGTATGAGAAACG | kk-d9-ekeke | 87 | 1197 |

TABLE 37-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 935965 | 4202 | 4217 | 22319 | 22334 | TCTCTATAGTGTTCCA | kk-d9-ekeke | 61 | 2632 |
| 935966 | 3072 | 3087 | 21189 | 21204 | AAGCTTGATAAAGGCT | kk-d9-ekeke | 62 | 2633 |
| 935967 | 3253 | 3268 | 21370 | 21385 | GACACTTTTAGAGAGG | kk-d9-ekeke | 78 | 451 |
| 935968 | 4229 | 4244 | 22346 | 22361 | CAGTTGTAAATGAGTC | kk-d9-ekeke | 28 | 560 |
| 935969 | 4592 | 4607 | 22709 | 22724 | GGAAGTTTACACTGGA | k-d9-kekeke | 68 | 2044 |
| 935970 | N/A | N/A | 8465 | 8480 | AGCATTTTATCATCCG | k-d9-kekeke | 76 | 1679 |

Example 8: Effect of Mixed MOE and cEt Gapmers with Phosphorothioate Internucleoside Linkages on Human IRF4 In Vitro, Single Dose Modified oligonucleotides complementary to a human IRF4 nucleic acid were designed and tested for their effect on IRF4 mRNA in vitro.

Cultured MM.1R cells at a density of 5,000 cells per well were transfected by free uptake with 1,000 nM concentration of modified oligonucleotide or no modified oligonucleotide for untreated controls. After approximately 24 hours, RNA was isolated from the cells and IRF4 mRNA levels were measured by quantitative real-time PCR. Human primer probe set hIRF4_LTS34726 (described hereinabove in Example 7) was used to measure mRNA levels. IRF4 mRNA levels were adjusted according to total RNA content, as measured by RIBOGREEN®. Results are presented in the table below as percent control of the amount of IRF4 mRNA, relative to untreated control (UTC) cells.

The modified oligonucleotides in Tables 38 through 42 are cEt and/or MOE containing gapmers. The modified oligonucleotides have a central gap segment comprising 2'-deoxynucleosides which is flanked by wing segments on the 5' direction and the 3' direction. At least one nucleoside in the 5' wing segment and/or one nucleoside in the 3' wing segment has a MOE and/or cEt sugar modification. The "Motif" column describes the sugar modifications of each oligonucleotide. "k" indicates a cEt sugar modification; "d" indicates deoxyribose; and "e" indicates a MOE modification. Each internucleoside linkage is a phosphorothioate internucleoside linkage and each cytosine residue is a 5-methylcytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Tables 38 through 42 below is complementary to human IRF4 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to human IRF4 reduced the amount of human IRF4 mRNA.

TABLE 38

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 37 | 195 |
| 881450 | 3252 | 3267 | 21369 | 21384 | ACACTTTTAGAGAGGA | kkk-d10-kkk | 53 | 2111 |
| 881659 | 4592 | 4607 | 22709 | 22724 | GGAAGTTTACACTGGA | kkk-d10-kkk | 14 | 2044 |
| 935570 | N/A | N/A | 8455 | 8470 | CATCCGAAAAGACTGG | kkk-d10-kkk | 86 | 2634 |
| 935571 | N/A | N/A | 8456 | 8471 | TCATCCGAAAAGACTG | kkk-d10-kkk | 84 | 2635 |
| 935572 | N/A | N/A | 8457 | 8472 | ATCATCCGAAAAGACT | kkk-d10-kkk | 96 | 2636 |
| 935573 | N/A | N/A | 8458 | 8473 | TATCATCCGAAAAGAC | kkk-d10-kkk | 97 | 2637 |
| 935574 | N/A | N/A | 8459 | 8474 | TTATCATCCGAAAAGA | kkk-d10-kkk | 96 | 2638 |
| 935575 | N/A | N/A | 8460 | 8475 | TTTATCATCCGAAAAG | kkk-d10-kkk | 93 | 2639 |
| 935576 | N/A | N/A | 8472 | 8487 | CAGCCGAAGCATTTTA | kkk-d10-kkk | 100 | 2640 |

TABLE 38-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 935577 | N/A | N/A | 8473 | 8488 | ACAGCCGAAGCATTTT | kkk-d10-kkk | 92 | 2641 |
| 935578 | N/A | N/A | 8474 | 8489 | GACAGCCGAAGCATTT | kkk-d10-kkk | 94 | 2642 |
| 935580 | N/A | N/A | 11115 | 11130 | GTGATGTCAGGTTTTC | kkk-d10-kkk | 34 | 2627 |
| 935581 | N/A | N/A | 11117 | 11132 | CAGTGATGTCAGGTTT | kkk-d10-kkk | 38 | 2629 |
| 935582 | N/A | N/A | 11118 | 11133 | GCAGTGATGTCAGGTT | kkk-d10-kkk | 61 | 2631 |
| 935584 | N/A | N/A | 11124 | 11139 | CCACAAGCAGTGATGT | kkk-d10-kkk | 84 | 2643 |
| 935585 | N/A | N/A | 11125 | 11140 | ACCACAAGCAGTGATG | kkk-d10-kkk | 99 | 2644 |
| 935586 | 2905 | 2920 | 21022 | 21037 | AACGGCCTGGAGGTGA | kkk-d10-kkk | 99 | 2645 |
| 935587 | 2906 | 2921 | 21023 | 21038 | AAACGGCCTGGAGGTG | kkk-d10-kkk | 89 | 2646 |
| 935588 | 2907 | 2922 | 21024 | 21039 | GAAACGGCCTGGAGGT | kkk-d10-kkk | 83 | 2647 |
| 935590 | 2920 | 2935 | 21037 | 21052 | TCCTGTAGTATGAGAA | kkk-d10-kkk | 78 | 2648 |
| 935591 | 2922 | 2937 | 21039 | 21054 | TATCCTGTAGTATGAG | kkk-d10-kkk | 58 | 2649 |
| 935593 | 3072 | 3087 | 21189 | 21204 | AAGCTTGATAAAGGCT | kkk-d10-kkk | 97 | 2633 |
| 935597 | 3080 | 3095 | 21197 | 21212 | TGCTCACTAAGCTTGA | kkk-d10-kkk | 88 | 2650 |
| 935603 | 4178 | 4193 | 22295 | 22310 | TAATTACTGCTTGAGG | kkk-d10-kkk | 38 | 2651 |
| 935606 | 4194 | 4209 | 22311 | 22326 | GTGTTCCAGGAGATAT | kkk-d10-kkk | 70 | 2652 |
| 935608 | 4196 | 4211 | 22313 | 22328 | TAGTGTTCCAGGAGAT | kkk-d10-kkk | 47 | 2653 |
| 935611 | 4208 | 4223 | 22325 | 22340 | CTTGGTTCTCTATAGT | kkk-d10-kkk | 73 | 2654 |
| 935614 | 4597 | 4612 | 22714 | 22729 | TGAACGGAAGTTTACA | kkk-d10-kkk | 86 | 2655 |
| 935616 | 5190 | 5205 | 23307 | 23322 | TACCTCAGTTTGTGAA | kkk-d10-kkk | 89 | 2656 |
| 935618 | N/A | N/A | 8466 | 8481 | AAGCATTTTATCATCC | kkk-d10-kkk | 75 | 2628 |
| 935619 | N/A | N/A | 8467 | 8482 | GAAGCATTTTATCATC | kkk-d10-kkk | 96 | 2630 |
| 935620 | 4202 | 4217 | 22319 | 22334 | TCTCTATAGTGTTCCA | kkk-d10-kkk | 30 | 2632 |
| 935621 | 4592 | 4607 | 22709 | 22724 | GGAAGTTTACACTGGA | k-d10-kekek | 67 | 2044 |
| 935622 | N/A | N/A | 8465 | 8480 | AGCATTTTATCATCCG | k-d10-kekek | 64 | 1679 |
| 935623 | N/A | N/A | 11116 | 11131 | AGTGATGTCAGGTTTT | k-d10-kekek | 75 | 1232 |
| 935624 | 5187 | 5202 | 23304 | 23319 | CTCAGTTTGTGAAGCA | k-d10-kekek | 76 | 1817 |
| 935625 | 4172 | 4187 | 22289 | 22304 | CTGCTTGAGGTTTTCC | k-d10-kekek | 92 | 1279 |
| 935626 | 2915 | 2930 | 21032 | 21047 | TAGTATGAGAAACGGC | k-d10-kekek | 76 | 1121 |
| 935627 | 4200 | 4215 | 22317 | 22332 | TCTATAGTGTTCCAGG | k-d10-kekek | 84 | 1734 |
| 935628 | 3070 | 3085 | 21187 | 21202 | GCTTGATAAAGGCTGA | k-d10-kekek | 83 | 1505 |
| 935629 | 3251 | 3266 | 21368 | 21383 | CACTTTTAGAGAGGAG | k-d10-kekek | 81 | 2036 |
| 935630 | 4591 | 4606 | 22708 | 22723 | GAAGTTTACACTGGAT | k-d10-kekek | 73 | 1968 |
| 935631 | N/A | N/A | 8464 | 8479 | GCATTTTATCATCCGA | k-d10-kekek | 79 | 1605 |
| 935632 | N/A | N/A | 11115 | 11130 | GTGATGTCAGGTTTTC | k-d10-kekek | 78 | 2627 |
| 935633 | 5186 | 5201 | 23303 | 23318 | TCAGTTTGTGAAGCAT | k-d10-kekek | 79 | 649 |

TABLE 38-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 935634 | 4171 | 4186 | 22288 | 22303 | TGCTTGAGGTTTTCCT | k-d10-kekek | 64 | 548 |
| 935635 | 2914 | 2929 | 21031 | 21046 | AGTATGAGAAACGGCC | k-d10-kekek | 90 | 1045 |
| 935636 | 4199 | 4214 | 22316 | 22331 | CTATAGTGTTCCAGGA | k-d10-kekek | 66 | 552 |
| 935637 | 3069 | 3084 | 21186 | 21201 | CTTGATAAAGGCTGAA | k-d10-kekek | 83 | 1427 |
| 935638 | 3250 | 3265 | 21367 | 21382 | ACTTTTAGAGAGGAGA | k-d10-kekek | 68 | 1960 |
| 935639 | 4593 | 4608 | 22710 | 22725 | CGGAAGTTTACACTGG | k-d10-kekek | 90 | 2119 |
| 935640 | N/A | N/A | 8466 | 8481 | AAGCATTTTATCATCC | k-d10-kekek | 86 | 2628 |
| 935641 | N/A | N/A | 11117 | 11132 | CAGTGATGTCAGGTTT | k-d10-kekek | 54 | 2629 |
| 935642 | 5188 | 5203 | 23305 | 23320 | CCTCAGTTTGTGAAGC | k-d10-kekek | 74 | 1894 |
| 935643 | 4173 | 4188 | 22290 | 22305 | ACTGCTTGAGGTTTTC | k-d10-kekek | 78 | 1356 |
| 935644 | 2916 | 2931 | 21033 | 21048 | GTAGTATGAGAAACGG | k-d10-kekek | 54 | 426 |
| 935645 | 4201 | 4216 | 22318 | 22333 | CTCTATAGTGTTCCAG | k-d10-kekek | 76 | 1811 |
| 935646 | 3071 | 3086 | 21188 | 21203 | AGCTTGATAAAGGCTG | k-d10-kekek | 99 | 1579 |
| 935647 | 3252 | 3267 | 21369 | 21384 | ACACTTTTAGAGAGGA | k-d10-kekek | 106 | 2111 |
| 935648 | 4228 | 4243 | 22345 | 22360 | AGTTGTAAATGAGTCG | k-d10-kekek | 56 | 2021 |
| 935649 | 4594 | 4609 | 22711 | 22726 | ACGGAAGTTTACACTG | k-d10-kekek | 93 | 2195 |
| 935650 | N/A | N/A | 8467 | 8482 | GAAGCATTTTATCATC | k-d10-kekek | 112 | 2630 |
| 935651 | N/A | N/A | 11118 | 11133 | GCAGTGATGTCAGGTT | k-d10-kekek | 64 | 2631 |
| 935652 | 5189 | 5204 | 23306 | 23321 | ACCTCAGTTTGTGAAG | k-d10-kekek | 82 | 1971 |
| 935653 | 4174 | 4189 | 22291 | 22306 | TACTGCTTGAGGTTTT | k-d10-kekek | 76 | 1433 |
| 935654 | 2917 | 2932 | 21034 | 21049 | TGTAGTATGAGAAACG | k-d10-kekek | 93 | 1197 |
| 935655 | 4202 | 4217 | 22319 | 22334 | TCTCTATAGTGTTCCA | k-d10-kekek | 39 | 2632 |
| 935656 | 3072 | 3087 | 21189 | 21204 | AAGCTTGATAAAGGCT | k-d10-kekek | 97 | 2633 |
| 935657 | 3253 | 3268 | 21370 | 21385 | GACACTTTTAGAGAGG | k-d10-kekek | 77 | 451 |
| 935658 | 4229 | 4244 | 22346 | 22361 | CAGTTGTAAATGAGTC | k-d10-kekek | 35 | 560 |
| 935659 | 4592 | 4607 | 22709 | 22724 | GGAAGTTTACACTGGA | kk-d9-kekek | 53 | 2044 |
| 935660 | N/A | N/A | 8465 | 8480 | AGCATTTTATCATCCG | kk-d9-kekek | 61 | 1679 |
| 935661 | N/A | N/A | 11116 | 11131 | AGTGATGTCAGGTTTT | kk-d9-kekek | 61 | 1232 |
| 935662 | 5187 | 5202 | 23304 | 23319 | CTCAGTTTGTGAAGCA | kk-d9-kekek | 78 | 1817 |
| 935663 | 4172 | 4187 | 22289 | 22304 | CTGCTTGAGGTTTTCC | kk-d9-kekek | 70 | 1279 |
| 935664 | 2915 | 2930 | 21032 | 21047 | TAGTATGAGAAACGGC | kk-d9-kekek | 73 | 1121 |
| 935665 | 4200 | 4215 | 22317 | 22332 | TCTATAGTGTTCCAGG | kk-d9-kekek | 72 | 1734 |
| 935666 | 3070 | 3085 | 21187 | 21202 | GCTTGATAAAGGCTGA | kk-d9-kekek | 93 | 1505 |

TABLE 39

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 37 | 195 |
| 881450 | 3252 | 3267 | 21369 | 21384 | ACACTTTTAGAGAGGA | kkk-d10-kkk | 49 | 2111 |
| 881659 | 4592 | 4607 | 22709 | 22724 | GGAAGTTTACACTGGA | kkk-d10-kkk | 15 | 2044 |
| 935667 | 3251 | 3266 | 21368 | 21383 | CACTTTTAGAGAGGAG | kk-d9-kekek | 83 | 2036 |
| 935668 | 4591 | 4606 | 22708 | 22723 | GAAGTTTACACTGGAT | kk-d9-kekek | 45 | 1968 |
| 935669 | N/A | N/A | 8464 | 8479 | GCATTTTATCATCCGA | kk-d9-kekek | 52 | 1605 |
| 935670 | N/A | N/A | 11115 | 11130 | GTGATGTCAGGTTTTC | kk-d9-kekek | 60 | 2627 |
| 935671 | 5186 | 5201 | 23303 | 23318 | TCAGTTTGTGAAGCAT | kk-d9-kekek | 42 | 649 |
| 935672 | 4171 | 4186 | 22288 | 22303 | TGCTTGAGGTTTTCCT | kk-d9-kekek | 64 | 548 |
| 935673 | 2914 | 2929 | 21031 | 21046 | AGTATGAGAAACGGCC | kk-d9-kekek | 97 | 1045 |
| 935674 | 4199 | 4214 | 22316 | 22331 | CTATAGTGTTCCAGGA | kk-d9-kekek | 57 | 552 |
| 935675 | 3069 | 3084 | 21186 | 21201 | CTTGATAAAGGCTGAA | kk-d9-kekek | 88 | 1427 |
| 935676 | 3250 | 3265 | 21367 | 21382 | ACTTTTAGAGAGGAGA | kk-d9-kekek | 60 | 1960 |
| 935677 | 4593 | 4608 | 22710 | 22725 | CGGAAGTTTACACTGG | kk-d9-kekek | 80 | 2119 |
| 935678 | N/A | N/A | 8466 | 8481 | AAGCATTTTATCATCC | kk-d9-kekek | 82 | 2628 |
| 935679 | N/A | N/A | 11117 | 11132 | CAGTGATGTCAGGTTT | kk-d9-kekek | 36 | 2629 |
| 935680 | 5188 | 5203 | 23305 | 23320 | CCTCAGTTTGTGAAGC | kk-d9-kekek | 85 | 1894 |
| 935681 | 4173 | 4188 | 22290 | 22305 | ACTGCTTGAGGTTTTC | kk-d9-kekek | 76 | 1356 |
| 935682 | 2916 | 2931 | 21033 | 21048 | GTAGTATGAGAAACGG | kk-d9-kekek | 50 | 426 |
| 935683 | 4201 | 4216 | 22318 | 22333 | CTCTATAGTGTTCCAG | kk-d9-kekek | 78 | 1811 |
| 935684 | 3071 | 3086 | 21188 | 21203 | AGCTTGATAAAGGCTG | kk-d9-kekek | 84 | 1579 |
| 935685 | 3252 | 3267 | 21369 | 21384 | ACACTTTTAGAGAGGA | kk-d9-kekek | 73 | 2111 |
| 935686 | 4228 | 4243 | 22345 | 22360 | AGTTGTAAATGAGTCG | kk-d9-kekek | 44 | 2021 |
| 935687 | 4594 | 4609 | 22711 | 22726 | ACGGAAGTTTACACTG | kk-d9-kekek | 79 | 2195 |
| 935688 | N/A | N/A | 8467 | 8482 | GAAGCATTTTATCATC | kk-d9-kekek | 120 | 2630 |
| 935689 | N/A | N/A | 11118 | 11133 | GCAGTGATGTCAGGTT | kk-d9-kekek | 31 | 2631 |
| 935690 | 5189 | 5204 | 23306 | 23321 | ACCTCAGTTTGTGAAG | kk-d9-kekek | 87 | 1971 |
| 935691 | 4174 | 4189 | 22291 | 22306 | TACTGCTTGAGGTTTT | kk-d9-kekek | 78 | 1433 |
| 935692 | 2917 | 2932 | 21034 | 21049 | TGTAGTATGAGAAACG | kk-d9-kekek | 88 | 1197 |
| 935693 | 4202 | 4217 | 22319 | 22334 | TCTCTATAGTGTTCCA | kk-d9-kekek | 72 | 2632 |
| 935694 | 3072 | 3087 | 21189 | 21204 | AAGCTTGATAAAGGCT | kk-d9-kekek | 119 | 2633 |
| 935695 | 3253 | 3268 | 21370 | 21385 | GACACTTTTAGAGAGG | kk-d9-kekek | 83 | 451 |
| 935696 | 4229 | 4244 | 22346 | 22361 | CAGTTGTAAATGAGTC | kk-d9-kekek | 19 | 560 |
| 935697 | 4592 | 4607 | 22709 | 22724 | GGAAGTTTACACTGGA | kkk-d9-kkke | 22 | 2044 |
| 935698 | N/A | N/A | 8465 | 8480 | AGCATTTTATCATCCG | kkk-d9-kkke | 34 | 1679 |
| 935699 | N/A | N/A | 11116 | 11131 | AGTGATGTCAGGTTTT | kkk-d9-kkke | 35 | 1232 |

TABLE 39-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 935700 | 5187 | 5202 | 23304 | 23319 | CTCAGTTTGTGAAGCA | kkk-d9-kkke | 31 | 1817 |
| 935701 | 4172 | 4187 | 22289 | 22304 | CTGCTTGAGGTTTTCC | kkk-d9-kkke | 35 | 1279 |
| 935702 | 2915 | 2930 | 21032 | 21047 | TAGTATGAGAAACGGC | kkk-d9-kkke | 52 | 1121 |
| 935703 | 4200 | 4215 | 22317 | 22332 | TCTATAGTGTTCCAGG | kkk-d9-kkke | 48 | 1734 |
| 935704 | 3070 | 3085 | 21187 | 21202 | GCTTGATAAAGGCTGA | kkk-d9-kkke | 77 | 1505 |
| 935705 | 3251 | 3266 | 21368 | 21383 | CACTTTTAGAGAGGAG | kkk-d9-kkke | 60 | 2036 |
| 935706 | 4591 | 4606 | 22708 | 22723 | GAAGTTTACACTGGAT | kkk-d9-kkke | 55 | 1968 |
| 935707 | N/A | N/A | 8464 | 8479 | GCATTTTATCATCCGA | kkk-d9-kkke | 38 | 1605 |
| 935708 | N/A | N/A | 11115 | 11130 | GTGATGTCAGGTTTTC | kkk-d9-kkke | 29 | 2627 |
| 935709 | 5186 | 5201 | 23303 | 23318 | TCAGTTTGTGAAGCAT | kkk-d9-kkke | 42 | 649 |
| 935710 | 4171 | 4186 | 22288 | 22303 | TGCTTGAGGTTTTCCT | kkk-d9-kkke | 54 | 548 |
| 935711 | 2914 | 2929 | 21031 | 21046 | AGTATGAGAAACGGCC | kkk-d9-kkke | 93 | 1045 |
| 935712 | 4199 | 4214 | 22316 | 22331 | CTATAGTGTTCCAGGA | kkk-d9-kkke | 69 | 552 |
| 935713 | 3069 | 3084 | 21186 | 21201 | CTTGATAAAGGCTGAA | kkk-d9-kkke | 64 | 1427 |
| 935714 | 3250 | 3265 | 21367 | 21382 | ACTTTTAGAGAGGAGA | kkk-d9-kkke | 64 | 1960 |
| 935715 | 4593 | 4608 | 22710 | 22725 | CGGAAGTTTACACTGG | kkk-d9-kkke | 75 | 2119 |
| 935716 | N/A | N/A | 8466 | 8481 | AAGCATTTTATCATCC | kkk-d9-kkke | 67 | 2628 |
| 935717 | N/A | N/A | 11117 | 11132 | CAGTGATGTCAGGTTT | kkk-d9-kkke | 51 | 2629 |
| 935718 | 5188 | 5203 | 23305 | 23320 | CCTCAGTTTGTGAAGC | kkk-d9-kkke | 98 | 1894 |
| 935719 | 4173 | 4188 | 22290 | 22305 | ACTGCTTGAGGTTTTC | kkk-d9-kkke | 48 | 1356 |
| 935720 | 2916 | 2931 | 21033 | 21048 | GTAGTATGAGAAACGG | kkk-d9-kkke | 60 | 426 |
| 935721 | 4201 | 4216 | 22318 | 22333 | CTCTATAGTGTTCCAG | kkk-d9-kkke | 35 | 1811 |
| 935722 | 3071 | 3086 | 21188 | 21203 | AGCTTGATAAAGGCTG | kkk-d9-kkke | 98 | 1579 |
| 935723 | 3252 | 3267 | 21369 | 21384 | ACACTTTTAGAGAGGA | kkk-d9-kkke | 71 | 2111 |
| 935724 | 4228 | 4243 | 22345 | 22360 | AGTTGTAAATGAGTCG | kkk-d9-kkke | 13 | 2021 |
| 935725 | 4594 | 4609 | 22711 | 22726 | ACGGAAGTTTACACTG | kkk-d9-kkke | 71 | 2195 |
| 935726 | N/A | N/A | 8467 | 8482 | GAAGCATTTTATCATC | kkk-d9-kkke | 99 | 2630 |
| 935727 | N/A | N/A | 11118 | 11133 | GCAGTGATGTCAGGTT | kkk-d9-kkke | 38 | 2631 |
| 935728 | 5189 | 5204 | 23306 | 23321 | ACCTCAGTTTGTGAAG | kkk-d9-kkke | 90 | 1971 |
| 935729 | 4174 | 4189 | 22291 | 22306 | TACTGCTTGAGGTTTT | kkk-d9-kkke | 87 | 1433 |
| 935730 | 2917 | 2932 | 21034 | 21049 | TGTAGTATGAGAAACG | kkk-d9-kkke | 67 | 1197 |
| 935731 | 4202 | 4217 | 22319 | 22334 | TCTCTATAGTGTTCCA | kkk-d9-kkke | 44 | 2632 |
| 935732 | 3072 | 3087 | 21189 | 21204 | AAGCTTGATAAAGGCT | kkk-d9-kkke | 95 | 2633 |
| 935733 | 3253 | 3268 | 21370 | 21385 | GACACTTTTAGAGAGG | kkk-d9-kkke | 76 | 451 |
| 935734 | 4229 | 4244 | 22346 | 22361 | CAGTTGTAAATGAGTC | kkk-d9-kkke | 32 | 560 |
| 935735 | 4592 | 4607 | 22709 | 22724 | GGAAGTTTACACTGGA | kk-d10-keke | 54 | 2044 |

TABLE 39-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 935736 | N/A | N/A | 8465 | 8480 | AGCATTTTATCATCCG | kk-d10-keke | 67 | 1679 |
| 935737 | N/A | N/A | 11116 | 11131 | AGTGATGTCAGGTTTT | kk-d10-keke | 68 | 1232 |
| 935738 | 5187 | 5202 | 23304 | 23319 | CTCAGTTTGTGAAGCA | kk-d10-keke | 70 | 1817 |
| 935739 | 4172 | 4187 | 22289 | 22304 | CTGCTTGAGGTTTTCC | kk-d10-keke | 56 | 1279 |
| 935740 | 2915 | 2930 | 21032 | 21047 | TAGTATGAGAAACGGC | kk-d10-keke | 54 | 1121 |
| 935741 | 4200 | 4215 | 22317 | 22332 | TCTATAGTGTTCCAGG | kk-d10-keke | 34 | 1734 |
| 935742 | 3070 | 3085 | 21187 | 21202 | GCTTGATAAAGGCTGA | kk-d10-keke | 69 | 1505 |

TABLE 40

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 37 | 195 |
| 881450 | 3252 | 3267 | 21369 | 21384 | ACACTTTTAGAGAGGA | kkk-d10-kkk | 53 | 2111 |
| 881659 | 4592 | 4607 | 22709 | 22724 | GGAAGTTTACACTGGA | kkk-d10-kkk | 20 | 2044 |
| 935743 | 3251 | 3266 | 21368 | 21383 | CACTTTTAGAGAGGAG | kk-d10-keke | 73 | 2036 |
| 935744 | 4591 | 4606 | 22708 | 22723 | GAAGTTTACACTGGAT | kk-d10-keke | 54 | 1968 |
| 935745 | N/A | N/A | 8464 | 8479 | GCATTTTATCATCCGA | kk-d10-keke | 61 | 1605 |
| 935746 | N/A | N/A | 11115 | 11130 | GTGATGTCAGGTTTTC | kk-d10-keke | 82 | 2627 |
| 935747 | 5186 | 5201 | 23303 | 23318 | TCAGTTTGTGAAGCAT | kk-d10-keke | 67 | 649 |
| 935748 | 4171 | 4186 | 22288 | 22303 | TGCTTGAGGTTTTCCT | kk-d10-keke | 67 | 548 |
| 935749 | 2914 | 2929 | 21031 | 21046 | AGTATGAGAAACGGCC | kk-d10-keke | 91 | 1045 |
| 935750 | 4199 | 4214 | 22316 | 22331 | CTATAGTGTTCCAGGA | kk-d10-keke | 64 | 552 |
| 935751 | 3069 | 3084 | 21186 | 21201 | CTTGATAAAGGCTGAA | kk-d10-keke | 96 | 1427 |
| 935752 | 3250 | 3265 | 21367 | 21382 | ACTTTTAGAGAGGAGA | kk-d10-keke | 77 | 1960 |
| 935753 | 4593 | 4608 | 22710 | 22725 | CGGAAGTTTACACTGG | kk-d10-keke | 67 | 2119 |
| 935754 | N/A | N/A | 8466 | 8481 | AAGCATTTTATCATCC | kk-d10-keke | 80 | 2628 |
| 935755 | N/A | N/A | 11117 | 11132 | CAGTGATGTCAGGTTT | kk-d10-keke | 59 | 2629 |
| 935756 | 5188 | 5203 | 23305 | 23320 | CCTCAGTTTGTGAAGC | kk-d10-keke | 84 | 1894 |
| 935757 | 4173 | 4188 | 22290 | 22305 | ACTGCTTGAGGTTTTC | kk-d10-keke | 79 | 1356 |
| 935758 | 2916 | 2931 | 21033 | 21048 | GTAGTATGAGAAACGG | kk-d10-keke | 72 | 426 |
| 935759 | 4201 | 4216 | 22318 | 22333 | CTCTATAGTGTTCCAG | kk-d10-keke | 73 | 1811 |
| 935760 | 3071 | 3086 | 21188 | 21203 | AGCTTGATAAAGGCTG | kk-d10-keke | 99 | 1579 |
| 935761 | 3252 | 3267 | 21369 | 21384 | ACACTTTTAGAGAGGA | kk-d10-keke | 86 | 2111 |
| 935762 | 4228 | 4243 | 22345 | 22360 | AGTTGTAAATGAGTCG | kk-d10-keke | 41 | 2021 |

TABLE 40-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 935763 | 4594 | 4609 | 22711 | 22726 | ACGGAAGTTTACACTG | kk-d10-keke | 87 | 2195 |
| 935764 | N/A | N/A | 8467 | 8482 | GAAGCATTTTATCATC | kk-d10-keke | 107 | 2630 |
| 935765 | N/A | N/A | 11118 | 11133 | GCAGTGATGTCAGGTT | kk-d10-keke | 33 | 2631 |
| 935766 | 5189 | 5204 | 23306 | 23321 | ACCTCAGTTTGTGAAG | kk-d10-keke | 112 | 1971 |
| 935767 | 4174 | 4189 | 22291 | 22306 | TACTGCTTGAGGTTTT | kk-d10-keke | 89 | 1433 |
| 935768 | 2917 | 2932 | 21034 | 21049 | TGTAGTATGAGAAACG | kk-d10-keke | 90 | 1197 |
| 935769 | 4202 | 4217 | 22319 | 22334 | TCTCTATAGTGTTCCA | kk-d10-keke | 73 | 2632 |
| 935770 | 3072 | 3087 | 21189 | 21204 | AAGCTTGATAAAGGCT | kk-d10-keke | 118 | 2633 |
| 935771 | 3253 | 3268 | 21370 | 21385 | GACACTTTTAGAGAGG | kk-d10-keke | 91 | 451 |
| 935772 | 4229 | 4244 | 22346 | 22361 | CAGTTGTAAATGAGTC | kk-d10-keke | 41 | 560 |
| 935773 | 4592 | 4607 | 22709 | 22724 | GGAAGTTTACACTGGA | kk-d9-kdkdk | 76 | 2044 |
| 935774 | N/A | N/A | 8465 | 8480 | AGCATTTTATCATCCG | kk-d9-kdkdk | 89 | 1679 |
| 935775 | N/A | N/A | 11116 | 11131 | AGTGATGTCAGGTTTT | kk-d9-kdkdk | 69 | 1232 |
| 935776 | 5187 | 5202 | 23304 | 23319 | CTCAGTTTGTGAAGCA | kk-d9-kdkdk | 101 | 1817 |
| 935777 | 4172 | 4187 | 22289 | 22304 | CTGCTTGAGGTTTTCC | kk-d9-kdkdk | 64 | 1279 |
| 935778 | 2915 | 2930 | 21032 | 21047 | TAGTATGAGAAACGGC | kk-d9-kdkdk | 61 | 1121 |
| 935779 | 4200 | 4215 | 22317 | 22332 | TCTATAGTGTTCCAGG | kk-d9-kdkdk | 50 | 1734 |
| 935780 | 3070 | 3085 | 21187 | 21202 | GCTTGATAAAGGCTGA | kk-d9-kdkdk | 96 | 1505 |
| 935781 | 3251 | 3266 | 21368 | 21383 | CACTTTTAGAGAGGAG | kk-d9-kdkdk | 84 | 2036 |
| 935782 | 4227 | 4242 | 22344 | 22359 | GTTGTAAATGAGTCGG | kk-d9-kdkdk | 42 | 559 |
| 935783 | 4591 | 4606 | 22708 | 22723 | GAAGTTTACACTGGAT | kk-d9-kdkdk | 77 | 1968 |
| 935784 | N/A | N/A | 8464 | 8479 | GCATTTTATCATCCGA | kk-d9-kdkdk | 84 | 1605 |
| 935785 | N/A | N/A | 11115 | 11130 | GTGATGTCAGGTTTTC | kk-d9-kdkdk | 73 | 2627 |
| 935786 | 5186 | 5201 | 23303 | 23318 | TCAGTTTGTGAAGCAT | kk-d9-kdkdk | 75 | 649 |
| 935787 | 4171 | 4186 | 22288 | 22303 | TGCTTGAGGTTTTCCT | kk-d9-kdkdk | 55 | 548 |
| 935788 | 2914 | 2929 | 21031 | 21046 | AGTATGAGAAACGGCC | kk-d9-kdkdk | 94 | 1045 |
| 935789 | 4199 | 4214 | 22316 | 22331 | CTATAGTGTTCCAGGA | kk-d9-kdkdk | 51 | 552 |
| 935790 | 3069 | 3084 | 21186 | 21201 | CTTGATAAAGGCTGAA | kk-d9-kdkdk | 99 | 1427 |
| 935791 | 3250 | 3265 | 21367 | 21382 | ACTTTTAGAGAGGAGA | kk-d9-kdkdk | 66 | 1960 |
| 935792 | 4226 | 4241 | 22343 | 22358 | TTGTAAATGAGTCGGT | kk-d9-kdkdk | 57 | 195 |
| 935793 | 4593 | 4608 | 22710 | 22725 | CGGAAGTTTACACTGG | kk-d9-kdkdk | 87 | 2119 |
| 935794 | N/A | N/A | 8466 | 8481 | AAGCATTTTATCATCC | kk-d9-kdkdk | 97 | 2628 |
| 935795 | N/A | N/A | 11117 | 11132 | CAGTGATGTCAGGTTT | kk-d9-kdkdk | 53 | 2629 |
| 935796 | 5188 | 5203 | 23305 | 23320 | CCTCAGTTTGTGAAGC | kk-d9-kdkdk | 92 | 1894 |
| 935797 | 4173 | 4188 | 22290 | 22305 | ACTGCTTGAGGTTTTC | kk-d9-kdkdk | 81 | 1356 |
| 935798 | 2916 | 2931 | 21033 | 21048 | GTAGTATGAGAAACGG | kk-d9-kdkdk | 68 | 426 |
| 935799 | 4201 | 4216 | 22318 | 22333 | CTCTATAGTGTTCCAG | kk-d9-kdkdk | 69 | 1811 |

TABLE 40-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 935800 | 3071 | 3086 | 21188 | 21203 | AGCTTGATAAAGGCTG | kk-d9-kdkdk | 103 | 1579 |
| 935801 | 3252 | 3267 | 21369 | 21384 | ACACTTTTAGAGAGGA | kk-d9-kdkdk | 97 | 2111 |
| 935802 | 4228 | 4243 | 22345 | 22360 | AGTTGTAAATGAGTCG | kk-d9-kdkdk | 61 | 2021 |
| 935803 | 4594 | 4609 | 22711 | 22726 | ACGGAAGTTTACACTG | kk-d9-kdkdk | 102 | 2195 |
| 935804 | N/A | N/A | 8467 | 8482 | GAAGCATTTTATCATC | kk-d9-kdkdk | 99 | 2630 |
| 935805 | N/A | N/A | 11118 | 11133 | GCAGTGATGTCAGGTT | kk-d9-kdkdk | 47 | 2631 |
| 935806 | 5189 | 5204 | 23306 | 23321 | ACCTCAGTTTGTGAAG | kk-d9-kdkdk | 103 | 1971 |
| 935807 | 4174 | 4189 | 22291 | 22306 | TACTGCTTGAGGTTTT | kk-d9-kdkdk | 85 | 1433 |
| 935808 | 2917 | 2932 | 21034 | 21049 | TGTAGTATGAGAAACG | kk-d9-kdkdk | 106 | 1197 |
| 935809 | 4202 | 4217 | 22319 | 22334 | TCTCTATAGTGTTCCA | kk-d9-kdkdk | 62 | 2632 |
| 935810 | 3072 | 3087 | 21189 | 21204 | AAGCTTGATAAAGGCT | kk-d9-kdkdk | 102 | 2633 |
| 935811 | 3253 | 3268 | 21370 | 21385 | GACACTTTTAGAGAGG | kk-d9-kdkdk | 86 | 451 |
| 935812 | 4229 | 4244 | 22346 | 22361 | CAGTTGTAAATGAGTC | kk-d9-kdkdk | 54 | 560 |
| 935813 | 4592 | 4607 | 22709 | 22724 | GGAAGTTTACACTGGA | kkk-d8-kekek | 57 | 2044 |
| 935814 | N/A | N/A | 8465 | 8480 | AGCATTTTATCATCCG | kkk-d8-kekek | 78 | 1679 |
| 935815 | N/A | N/A | 11116 | 11131 | AGTGATGTCAGGTTTT | kkk-d8-kekek | 63 | 1232 |
| 935816 | 5187 | 5202 | 23304 | 23319 | CTCAGTTTGTGAAGCA | kkk-d8-kekek | 63 | 1817 |
| 935817 | 4172 | 4187 | 22289 | 22304 | CTGCTTGAGGTTTTCC | kkk-d8-kekek | 74 | 1279 |
| 935818 | 2915 | 2930 | 21032 | 21047 | TAGTATGAGAAACGGC | kkk-d8-kekek | 70 | 1121 |

TABLE 41

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 34 | 195 |
| 881450 | 3252 | 3267 | 21369 | 21384 | ACACTTTTAGAGAGGA | kkk-d10-kkk | 63 | 2111 |
| 881659 | 4592 | 4607 | 22709 | 22724 | GGAAGTTTACACTGGA | kkk-d10-kkk | 17 | 2044 |
| 935819 | 4200 | 4215 | 22317 | 22332 | TCTATAGTGTTCCAGG | kkk-d8-kekek | 87 | 1734 |
| 935820 | 3070 | 3085 | 21187 | 21202 | GCTTGATAAAGGCTGA | kkk-d8-kekek | 99 | 1505 |
| 935821 | 3251 | 3266 | 21368 | 21383 | CACTTTTAGAGAGGAG | kkk-d8-kekek | 93 | 2036 |
| 935822 | 4591 | 4606 | 22708 | 22723 | GAAGTTTACACTGGAT | kkk-d8-kekek | 48 | 1968 |
| 935823 | N/A | N/A | 8464 | 8479 | GCATTTTATCATCCGA | kkk-d8-kekek | 55 | 1605 |
| 935824 | N/A | N/A | 11115 | 11130 | GTGATGTCAGGTTTTC | kkk-d8-kekek | 43 | 2627 |
| 935825 | 5186 | 5201 | 23303 | 23318 | TCAGTTTGTGAAGCAT | kkk-d8-kekek | 59 | 649 |
| 935826 | 4171 | 4186 | 22288 | 22303 | TGCTTGAGGTTTTCCT | kkk-d8-kekek | 73 | 548 |

TABLE 41-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 935827 | 2914 | 2929 | 21031 | 21046 | AGTATGAGAAACGGCC | kkk-d8-kekek | 90 | 1045 |
| 935828 | 4199 | 4214 | 22316 | 22331 | CTATAGTGTTCCAGGA | kkk-d8-kekek | 77 | 552 |
| 935829 | 3069 | 3084 | 21186 | 21201 | CTTGATAAAGGCTGAA | kkk-d8-kekek | 88 | 1427 |
| 935830 | 3250 | 3265 | 21367 | 21382 | ACTTTTAGAGAGGAGA | kkk-d8-kekek | 79 | 1960 |
| 935831 | 4593 | 4608 | 22710 | 22725 | CGGAAGTTTACACTGG | kkk-d8-kekek | 82 | 2119 |
| 935832 | N/A | N/A | 8466 | 8481 | AAGCATTTTATCATCC | kkk-d8-kekek | 90 | 2628 |
| 935833 | N/A | N/A | 11117 | 11132 | CAGTGATGTCAGGTTT | kkk-d8-kekek | 44 | 2629 |
| 935834 | 5188 | 5203 | 23305 | 23320 | CCTCAGTTTGTGAAGC | kkk-d8-kekek | 97 | 1894 |
| 935835 | 4173 | 4188 | 22290 | 22305 | ACTGCTTGAGGTTTTC | kkk-d8-kekek | 68 | 1356 |
| 935836 | 2916 | 2931 | 21033 | 21048 | GTAGTATGAGAAACGG | kkk-d8-kekek | 57 | 426 |
| 935837 | 4201 | 4216 | 22318 | 22333 | CTCTATAGTGTTCCAG | kkk-d8-kekek | 85 | 1811 |
| 935838 | 3071 | 3086 | 21188 | 21203 | AGCTTGATAAAGGCTG | kkk-d8-kekek | 108 | 1579 |
| 935839 | 3252 | 3267 | 21369 | 21384 | ACACTTTTAGAGAGGA | kkk-d8-kekek | 85 | 2111 |
| 935840 | 4228 | 4243 | 22345 | 22360 | AGTTGTAAATGAGTCG | kkk-d8-kekek | 39 | 2021 |
| 935841 | 4594 | 4609 | 22711 | 22726 | ACGGAAGTTTACACTG | kkk-d8-kekek | 86 | 2195 |
| 935842 | N/A | N/A | 8467 | 8482 | GAAGCATTTTATCATC | kkk-d8-kekek | 105 | 2630 |
| 935843 | N/A | N/A | 11118 | 11133 | GCAGTGATGTCAGGTT | kkk-d8-kekek | 64 | 2631 |
| 935844 | 5189 | 5204 | 23306 | 23321 | ACCTCAGTTTGTGAAG | kkk-d8-kekek | 103 | 1971 |
| 935845 | 4174 | 4189 | 22291 | 22306 | TACTGCTTGAGGTTTT | kkk-d8-kekek | 108 | 1433 |
| 935846 | 2917 | 2932 | 21034 | 21049 | TGTAGTATGAGAAACG | kkk-d8-kekek | 77 | 1197 |
| 935847 | 4202 | 4217 | 22319 | 22334 | TCTCTATAGTGTTCCA | kkk-d8-kekek | 92 | 2632 |
| 935848 | 3072 | 3087 | 21189 | 21204 | AAGCTTGATAAAGGCT | kkk-d8-kekek | 104 | 2633 |
| 935849 | 3253 | 3268 | 21370 | 21385 | GACACTTTTAGAGAGG | kkk-d8-kekek | 108 | 451 |
| 935850 | 4229 | 4244 | 22346 | 22361 | CAGTTGTAAATGAGTC | kkk-d8-kekek | 24 | 560 |
| 935851 | 4592 | 4607 | 22709 | 22724 | GGAAGTTTACACTGGA | kkk-d9-keke | 22 | 2044 |
| 935852 | N/A | N/A | 8465 | 8480 | AGCATTTTATCATCCG | kkk-d9-keke | 58 | 1679 |
| 935853 | N/A | N/A | 11116 | 11131 | AGTGATGTCAGGTTTT | kkk-d9-keke | 41 | 1232 |
| 935854 | 5187 | 5202 | 23304 | 23319 | CTCAGTTTGTGAAGCA | kkk-d9-keke | 36 | 1817 |
| 935855 | 4172 | 4187 | 22289 | 22304 | CTGCTTGAGGTTTTCC | kkk-d9-keke | 50 | 1279 |
| 935856 | 2915 | 2930 | 21032 | 21047 | TAGTATGAGAAACGGC | kkk-d9-keke | 38 | 1121 |
| 935857 | 4200 | 4215 | 22317 | 22332 | TCTATAGTGTTCCAGG | kkk-d9-keke | 32 | 1734 |
| 935858 | 3070 | 3085 | 21187 | 21202 | GCTTGATAAAGGCTGA | kkk-d9-keke | 76 | 1505 |
| 935859 | 3251 | 3266 | 21368 | 21383 | CACTTTTAGAGAGGAG | kkk-d9-keke | 43 | 2036 |
| 935860 | 4591 | 4606 | 22708 | 22723 | GAAGTTTACACTGGAT | kkk-d9-keke | 51 | 1968 |
| 935861 | N/A | N/A | 8464 | 8479 | GCATTTTATCATCCGA | kkk-d9-keke | 68 | 1605 |
| 935862 | N/A | N/A | 11115 | 11130 | GTGATGTCAGGTTTTC | kkk-d9-keke | 66 | 2627 |
| 935863 | 5186 | 5201 | 23303 | 23318 | TCAGTTTGTGAAGCAT | kkk-d9-keke | 47 | 649 |

TABLE 41-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 935864 | 4171 | 4186 | 22288 | 22303 | TGCTTGAGGTTTTCCT | kkk-d9-keke | 65 | 548 |
| 935865 | 2914 | 2929 | 21031 | 21046 | AGTATGAGAAACGGCC | kkk-d9-keke | 84 | 1045 |
| 935866 | 4199 | 4214 | 22316 | 22331 | CTATAGTGTTCCAGGA | kkk-d9-keke | 78 | 552 |
| 935867 | 3069 | 3084 | 21186 | 21201 | CTTGATAAAGGCTGAA | kkk-d9-keke | 76 | 1427 |
| 935868 | 3250 | 3265 | 21367 | 21382 | ACTTTTAGAGAGGAGA | kkk-d9-keke | 59 | 1960 |
| 935869 | 4593 | 4608 | 22710 | 22725 | CGGAAGTTTACACTGG | kkk-d9-keke | 58 | 2119 |
| 935870 | N/A | N/A | 8466 | 8481 | AAGCATTTTATCATCC | kkk-d9-keke | 79 | 2628 |
| 935871 | N/A | N/A | 11117 | 11132 | CAGTGATGTCAGGTTT | kkk-d9-keke | 66 | 2629 |
| 935872 | 5188 | 5203 | 23305 | 23320 | CCTCAGTTTGTGAAGC | kkk-d9-keke | 92 | 1894 |
| 935873 | 4173 | 4188 | 22290 | 22305 | ACTGCTTGAGGTTTTC | kkk-d9-keke | 62 | 1356 |
| 935874 | 2916 | 2931 | 21033 | 21048 | GTAGTATGAGAAACGG | kkk-d9-keke | 85 | 426 |
| 935875 | 4201 | 4216 | 22318 | 22333 | CTCTATAGTGTTCCAG | kkk-d9-keke | 51 | 1811 |
| 935876 | 3071 | 3086 | 21188 | 21203 | AGCTTGATAAAGGCTG | kkk-d9-keke | 108 | 1579 |
| 935877 | 3252 | 3267 | 21369 | 21384 | ACACTTTTAGAGAGGA | kkk-d9-keke | 63 | 2111 |
| 935878 | 4228 | 4243 | 22345 | 22360 | AGTTGTAAATGAGTCG | kkk-d9-keke | 23 | 2021 |
| 935879 | 4594 | 4609 | 22711 | 22726 | ACGGAAGTTTACACTG | kkk-d9-keke | 87 | 2195 |
| 935880 | N/A | N/A | 8467 | 8482 | GAAGCATTTTATCATC | kkk-d9-keke | 92 | 2630 |
| 935881 | N/A | N/A | 11118 | 11133 | GCAGTGATGTCAGGTT | kkk-d9-keke | 44 | 2631 |
| 935882 | 5189 | 5204 | 23306 | 23321 | ACCTCAGTTTGTGAAG | kkk-d9-keke | 92 | 1971 |
| 935883 | 4174 | 4189 | 22291 | 22306 | TACTGCTTGAGGTTTT | kkk-d9-keke | 93 | 1433 |
| 935884 | 2917 | 2932 | 21034 | 21049 | TGTAGTATGAGAAACG | kkk-d9-keke | 71 | 1197 |
| 935885 | 4202 | 4217 | 22319 | 22334 | TCTCTATAGTGTTCCA | kkk-d9-keke | 67 | 2632 |
| 935886 | 3072 | 3087 | 21189 | 21204 | AAGCTTGATAAAGGCT | kkk-d9-keke | 118 | 2633 |
| 935887 | 3253 | 3268 | 21370 | 21385 | GACACTTTTAGAGAGG | kkk-d9-keke | 76 | 451 |
| 935888 | 4229 | 4244 | 22346 | 22361 | CAGTTGTAAATGAGTC | kkk-d9-keke | 42 | 560 |
| 935889 | 4592 | 4607 | 22709 | 22724 | GGAAGTTTACACTGGA | kk-d9-eeekk | 53 | 2044 |
| 935890 | N/A | N/A | 8465 | 8480 | AGCATTTTATCATCCG | kk-d9-eeekk | 72 | 1679 |
| 935891 | N/A | N/A | 11116 | 11131 | AGTGATGTCAGGTTTT | kk-d9-eeekk | 75 | 1232 |
| 935892 | 5187 | 5202 | 23304 | 23319 | CTCAGTTTGTGAAGCA | kk-d9-eeekk | 82 | 1817 |
| 935893 | 4172 | 4187 | 22289 | 22304 | CTGCTTGAGGTTTTCC | kk-d9-eeekk | 69 | 1279 |
| 935894 | 2915 | 2930 | 21032 | 21047 | TAGTATGAGAAACGGC | kk-d9-eeekk | 63 | 1121 |

TABLE 42

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 31 | 195 |
| 881450 | 3252 | 3267 | 21369 | 21384 | ACACTTTTAGAGAGGA | kkk-d10-kkk | 54 | 2111 |
| 881659 | 4592 | 4607 | 22709 | 22724 | GGAAGTTTACACTGGA | kkk-d10-kkk | 15 | 2044 |
| 935971 | N/A | N/A | 11116 | 11131 | AGTGATGTCAGGTTTT | k-d9-kekeke | 60 | 1232 |
| 935972 | 5187 | 5202 | 23304 | 23319 | CTCAGTTTGTGAAGCA | k-d9-kekeke | 81 | 1817 |
| 935973 | 4172 | 4187 | 22289 | 22304 | CTGCTTGAGGTTTTCC | k-d9-kekeke | 80 | 1279 |
| 935974 | 2915 | 2930 | 21032 | 21047 | TAGTATGAGAAACGGC | k-d9-kekeke | 68 | 1121 |
| 935975 | 4200 | 4215 | 22317 | 22332 | TCTATAGTGTTCCAGG | k-d9-kekeke | 88 | 1734 |
| 935976 | 3070 | 3085 | 21187 | 21202 | GCTTGATAAAGGCTGA | k-d9-kekeke | 101 | 1505 |
| 935977 | 3251 | 3266 | 21368 | 21383 | CACTTTTAGAGAGGAG | k-d9-kekeke | 91 | 2036 |
| 935978 | 4591 | 4606 | 22708 | 22723 | GAAGTTTACACTGGAT | k-d9-kekeke | 89 | 1968 |
| 935979 | N/A | N/A | 8464 | 8479 | GCATTTTATCATCCGA | k-d9-kekeke | 77 | 1605 |
| 935980 | N/A | N/A | 11115 | 11130 | GTGATGTCAGGTTTTC | k-d9-kekeke | 70 | 2627 |
| 935981 | 5186 | 5201 | 23303 | 23318 | TCAGTTTGTGAAGCAT | k-d9-kekeke | 91 | 649 |
| 935982 | 4171 | 4186 | 22288 | 22303 | TGCTTGAGGTTTTCCT | k-d9-kekeke | 91 | 548 |
| 935983 | 2914 | 2929 | 21031 | 21046 | AGTATGAGAAACGGCC | k-d9-kekeke | 96 | 1045 |
| 935984 | 4199 | 4214 | 22316 | 22331 | CTATAGTGTTCCAGGA | k-d9-kekeke | 88 | 552 |
| 935985 | 3069 | 3084 | 21186 | 21201 | CTTGATAAAGGCTGAA | k-d9-kekeke | 95 | 1427 |
| 935986 | 3250 | 3265 | 21367 | 21382 | ACTTTTAGAGAGGAGA | k-d9-kekeke | 83 | 1960 |
| 935987 | 4593 | 4608 | 22710 | 22725 | CGGAAGTTTACACTGG | k-d9-kekeke | 83 | 2119 |
| 935988 | N/A | N/A | 8466 | 8481 | AAGCATTTTATCATCC | k-d9-kekeke | 94 | 2628 |
| 935989 | N/A | N/A | 11117 | 11132 | CAGTGATGTCAGGTTT | k-d9-kekeke | 52 | 2629 |
| 935990 | 5188 | 5203 | 23305 | 23320 | CCTCAGTTTGTGAAGC | k-d9-kekeke | 89 | 1894 |
| 935991 | 4173 | 4188 | 22290 | 22305 | ACTGCTTGAGGTTTTC | k-d9-kekeke | 79 | 1356 |
| 935992 | 2916 | 2931 | 21033 | 21048 | GTAGTATGAGAAACGG | k-d9-kekeke | 72 | 426 |
| 935993 | 4201 | 4216 | 22318 | 22333 | CTCTATAGTGTTCCAG | k-d9-kekeke | 89 | 1811 |
| 935994 | 3071 | 3086 | 21188 | 21203 | AGCTTGATAAAGGCTG | k-d9-kekeke | 98 | 1579 |
| 935995 | 3252 | 3267 | 21369 | 21384 | ACACTTTTAGAGAGGA | k-d9-kekeke | 94 | 2111 |
| 935996 | 4228 | 4243 | 22345 | 22360 | AGTTGTAAATGAGTCG | k-d9-kekeke | 53 | 2021 |
| 935997 | 4594 | 4609 | 22711 | 22726 | ACGGAAGTTTACACTG | k-d9-kekeke | 98 | 2195 |
| 935998 | N/A | N/A | 8467 | 8482 | GAAGCATTTTATCATC | k-d9-kekeke | 96 | 2630 |
| 935999 | N/A | N/A | 11118 | 11133 | GCAGTGATGTCAGGTT | k-d9-kekeke | 67 | 2631 |
| 936000 | 5189 | 5204 | 23306 | 23321 | ACCTCAGTTTGTGAAG | k-d9-kekeke | 84 | 1971 |
| 936001 | 4174 | 4189 | 22291 | 22306 | TACTGCTTGAGGTTTT | k-d9-kekeke | 86 | 1433 |
| 936002 | 2917 | 2932 | 21034 | 21049 | TGTAGTATGAGAAACG | k-d9-kekeke | 86 | 1197 |
| 936003 | 4202 | 4217 | 22319 | 22334 | TCTCTATAGTGTTCCA | k-d9-kekeke | 82 | 2632 |
| 936004 | 3072 | 3087 | 21189 | 21204 | AAGCTTGATAAAGGCT | k-d9-kekeke | 98 | 2633 |

TABLE 42-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 936005 | 3253 | 3268 | 21370 | 21385 | GACACTTTTAGAGAGG | k-d9-kekeke | 91 | 451 |
| 936006 | 4229 | 4244 | 22346 | 22361 | CAGTTGTAAATGAGTC | k-d9-kekeke | 38 | 560 |
| 936007 | 4592 | 4607 | 22709 | 22724 | GGAAGTTTACACTGGA | ekk-d9-kkee | 45 | 2044 |
| 936008 | N/A | N/A | 8465 | 8480 | AGCATTTTATCATCCG | ekk-d9-kkee | 57 | 1679 |
| 936009 | N/A | N/A | 11116 | 11131 | AGTGATGTCAGGTTTT | ekk-d9-kkee | 61 | 1232 |
| 936010 | 5187 | 5202 | 23304 | 23319 | CTCAGTTTGTGAAGCA | ekk-d9-kkee | 55 | 1817 |
| 936011 | 4172 | 4187 | 22289 | 22304 | CTGCTTGAGGTTTTCC | ekk-d9-kkee | 48 | 1279 |
| 936012 | 2915 | 2930 | 21032 | 21047 | TAGTATGAGAAACGGC | ekk-d9-kkee | 62 | 1121 |
| 936013 | 4200 | 4215 | 22317 | 22332 | TCTATAGTGTTCCAGG | ekk-d9-kkee | 42 | 1734 |
| 936014 | 3070 | 3085 | 21187 | 21202 | GCTTGATAAAGGCTGA | ekk-d9-kkee | 65 | 1505 |
| 936015 | 3251 | 3266 | 21368 | 21383 | CACTTTTAGAGAGGAG | ekk-d9-kkee | 59 | 2036 |
| 936016 | 4227 | 4242 | 22344 | 22359 | GTTGTAAATGAGTCGG | ekk-d9-kkee | 31 | 559 |
| 936017 | 4591 | 4606 | 22708 | 22723 | GAAGTTTACACTGGAT | ekk-d9-kkee | 52 | 1968 |
| 936018 | N/A | N/A | 8464 | 8479 | GCATTTTATCATCCGA | ekk-d9-kkee | 39 | 1605 |
| 936019 | N/A | N/A | 11115 | 11130 | GTGATGTCAGGTTTTC | ekk-d9-kkee | 52 | 2627 |
| 936020 | 5186 | 5201 | 23303 | 23318 | TCAGTTTGTGAAGCAT | ekk-d9-kkee | 53 | 649 |
| 936021 | 4171 | 4186 | 22288 | 22303 | TGCTTGAGGTTTTCCT | ekk-d9-kkee | 65 | 548 |
| 936022 | 2914 | 2929 | 21031 | 21046 | AGTATGAGAAACGGCC | ekk-d9-kkee | 88 | 1045 |
| 936023 | 4199 | 4214 | 22316 | 22331 | CTATAGTGTTCCAGGA | ekk-d9-kkee | 92 | 552 |
| 936024 | 3069 | 3084 | 21186 | 21201 | CTTGATAAAGGCTGAA | ekk-d9-kkee | 83 | 1427 |
| 936025 | 3250 | 3265 | 21367 | 21382 | ACTTTTAGAGAGGAGA | ekk-d9-kkee | 72 | 1960 |
| 936026 | 4226 | 4241 | 22343 | 22358 | TTGTAAATGAGTCGGT | ekk-d9-kkee | 49 | 195 |
| 936027 | 4593 | 4608 | 22710 | 22725 | CGGAAGTTTACACTGG | ekk-d9-kkee | 76 | 2119 |
| 936028 | N/A | N/A | 8466 | 8481 | AAGCATTTTATCATCC | ekk-d9-kkee | 86 | 2628 |
| 936029 | N/A | N/A | 11117 | 11132 | CAGTGATGTCAGGTTT | ekk-d9-kkee | 80 | 2629 |
| 936030 | 5188 | 5203 | 23305 | 23320 | CCTCAGTTTGTGAAGC | ekk-d9-kkee | 89 | 1894 |
| 936031 | 4173 | 4188 | 22290 | 22305 | ACTGCTTGAGGTTTTC | ekk-d9-kkee | 54 | 1356 |
| 936032 | 2916 | 2931 | 21033 | 21048 | GTAGTATGAGAAACGG | ekk-d9-kkee | 71 | 426 |
| 936033 | 4201 | 4216 | 22318 | 22333 | CTCTATAGTGTTCCAG | ekk-d9-kkee | 41 | 1811 |
| 936034 | 3071 | 3086 | 21188 | 21203 | AGCTTGATAAAGGCTG | ekk-d9-kkee | 99 | 1579 |
| 936035 | 3252 | 3267 | 21369 | 21384 | ACACTTTTAGAGAGGA | ekk-d9-kkee | 71 | 2111 |
| 936036 | 4228 | 4243 | 22345 | 22360 | AGTTGTAAATGAGTCG | ekk-d9-kkee | 51 | 2021 |
| 936037 | 4594 | 4609 | 22711 | 22726 | ACGGAAGTTTACACTG | ekk-d9-kkee | 83 | 2195 |
| 936038 | N/A | N/A | 8467 | 8482 | GAAGCATTTTATCATC | ekk-d9-kkee | 99 | 2630 |
| 936039 | N/A | N/A | 11118 | 11133 | GCAGTGATGTCAGGTT | ekk-d9-kkee | 44 | 2631 |
| 936040 | 5189 | 5204 | 23306 | 23321 | ACCTCAGTTTGTGAAG | ekk-d9-kkee | 98 | 1971 |

TABLE 42-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 936041 | 4174 | 4189 | 22291 | 22306 | TACTGCTTGAGGTTTT | ekk-d9-kkee | 94 | 1433 |
| 936042 | 2917 | 2932 | 21034 | 21049 | TGTAGTATGAGAAACG | ekk-d9-kkee | 94 | 1197 |
| 936043 | 4202 | 4217 | 22319 | 22334 | TCTCTATAGTGTTCCA | ekk-d9-kkee | 61 | 2632 |
| 936044 | 3072 | 3087 | 21189 | 21204 | AAGCTTGATAAAGGCT | ekk-d9-kkee | 101 | 2633 |
| 936045 | 3253 | 3268 | 21370 | 21385 | GACACTTTTAGAGAGG | ekk-d9-kkee | 76 | 451 |
| 936046 | 4229 | 4244 | 22346 | 22361 | CAGTTGTAAATGAGTC | ekk-d9-kkee | 45 | 560 |

Example 9: Effect of 3-10-3 cEt Gapmers with Phosphorothioate Internucleoside Linkages on Human IRF4 In Vitro, Single Dose Modified oligonucleotides complementary to a human IRF4 nucleic acid were designed and tested for their effect on IRF4 mRNA in vitro.

Cultured MM.1R cells at a density of 5,000 cells per well were transfected by free uptake with 1,000 nM concentration of modified oligonucleotide or no modified oligonucleotide for untreated controls. After approximately 24 hours, RNA was isolated from the cells and IRF4 mRNA levels were measured by quantitative real-time PCR. Human primer probe set hIRF4_LTS34726 (described hereinabove in Example 7) was used to measure mRNA levels. IRF4 mRNA levels were adjusted according to total RNA content, as measured by RIBOGREEN®. Results are presented in the table below as percent control of the amount of IRF4 mRNA, relative to untreated control (UTC) cells.

The modified oligonucleotides in Tables 43 through 52 are 3-10-3 cEt gapmers. The gapmers are 16 nucleobases in length, wherein the central gap segment comprises ten 2'-deoxynucleosides and is flanked by wing segments on both the 5' end and on the 3' end comprising three cEt nucleosides. The sugar motif for the gapmers is (from 5' to 3'): kkkddddddddddkkk; wherein 'd' represents a 2'-deoxyribose sugar and 'k' represents a cEt modified sugar. Each internucleoside linkage is a phosphorothioate internucleoside linkage and each cytosine residue is a 5-methylcytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Tables 43 through 52 below is complementary to human IRF4 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to human IRF4 reduced the amount of human IRF4 mRNA.

TABLE 43

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 37 | 195 |
| 969844 | N/A | N/A | 3801 | 3816 | CCTTACCTCGCCCTGG | 131 | 2657 |
| 969854 | N/A | N/A | 4265 | 4280 | CGCCAGCGGGTGAGCA | 81 | 2658 |
| 969864 | N/A | N/A | 4371 | 4386 | GGCGACGACAGCTGCG | 115 | 2659 |
| 969874 | N/A | N/A | 4518 | 4533 | AGCTAGCGCGCACTAA | 108 | 2660 |
| 969884 | N/A | N/A | 4836 | 4851 | TCCTGTAACGCACCCG | 113 | 2661 |
| 969894 | N/A | N/A | 5487 | 5502 | CCTGATGCCTCCGCCG | 94 | 2662 |
| 969904 | N/A | N/A | 5667 | 5682 | CGAGAACGCACGGACG | 111 | 2663 |
| 969914 | N/A | N/A | 5761 | 5776 | GCACAGGCGCGGACGC | 106 | 2664 |
| 969924 | N/A | N/A | 6002 | 6017 | GTGCACTCGCGCAAAG | 105 | 2665 |
| 969934 | N/A | N/A | 6266 | 6281 | TGCGGAGGTTCCTTGA | 88 | 2666 |

TABLE 43-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 969944 | N/A | N/A | 6317 | 6332 | CTGCCAAGTTGAAGAC | 67 | 2667 |
| 969954 | N/A | N/A | 6407 | 6422 | GTCCTTCAGATTTACA | 117 | 2668 |
| 969964 | N/A | N/A | 6771 | 6786 | ATACATGTCTGGTTTA | 96 | 2669 |
| 969974 | 511 | 526 | 6990 | 7005 | TTTTGGCTCCCTCAGG | 103 | 2670 |
| 969984 | N/A | N/A | 7169 | 7184 | TTTCAACTTGTGACCC | 99 | 2671 |
| 969994 | N/A | N/A | 7222 | 7237 | ATACATTGAGGCATAC | 98 | 2672 |
| 970004 | N/A | N/A | 7577 | 7592 | GACATAAAGGACCCCG | 92 | 2673 |
| 970014 | N/A | N/A | 7639 | 7654 | GGTCTGAGTTGTACAG | 80 | 2674 |
| 970024 | N/A | N/A | 8104 | 8119 | CACCAATGGCAGCACC | 84 | 2675 |
| 970034 | N/A | N/A | 8221 | 8236 | CATGATAAGGCACTAC | 106 | 2676 |
| 970044 | N/A | N/A | 8384 | 8399 | TGGAGATACTTGTACT | 58 | 2677 |
| 970054 | N/A | N/A | 8489 | 8504 | ATCCCTTATTAGACTG | 107 | 2678 |
| 970064 | 645 | 660 | 9135 | 9150 | CCAGCTTCGGTCGAGG | 105 | 2679 |
| 970074 | 701 | 716 | 9191 | 9206 | GTCATGGGACATTGGT | 74 | 2680 |
| 970084 | N/A | N/A | 9431 | 9446 | CTGAGAGTAAACTTGG | 101 | 2681 |
| 970094 | N/A | N/A | 9582 | 9597 | GCTCAATAATCTCCCA | 100 | 2682 |
| 970104 | N/A | N/A | 9679 | 9694 | GTGTTTGCCATGGTAT | 43 | 2683 |
| 970114 | N/A | N/A | 9842 | 9857 | CGCATTGCTAGATTCT | 63 | 2684 |
| 970124 | N/A | N/A | 9987 | 10002 | GGATAACCTGAACATG | 91 | 2685 |
| 970134 | N/A | N/A | 10120 | 10135 | CCATATTGGAAACCAG | 90 | 2686 |
| 970144 | N/A | N/A | 10178 | 10193 | CAGTAAACGCAAGTCT | 114 | 2687 |
| 970154 | N/A | N/A | 10262 | 10277 | AGACAGGTCTCTACCT | 112 | 2688 |
| 970164 | N/A | N/A | 10449 | 10464 | TGCCAAAGAGCCCAAT | 119 | 2689 |
| 970174 | N/A | N/A | 10675 | 10690 | AACTAGCAGGGCACGC | 98 | 2690 |
| 970184 | 811 | 826 | 10876 | 10891 | GGACTCCGGGAGCCTG | 108 | 2691 |
| 970194 | N/A | N/A | 11103 | 11118 | TTTCTAATGGTGCTCC | 96 | 2692 |
| 970203 | N/A | N/A | 11365 | 11380 | AACTAATGTCCCCAGG | 112 | 2693 |
| 970213 | N/A | N/A | 11452 | 11467 | TTGTTTGCAAGCTATA | 64 | 2694 |
| 970223 | N/A | N/A | 11540 | 11555 | TTCTTTATAGTAGGTA | 85 | 2695 |
| 970233 | N/A | N/A | 11664 | 11679 | GAATTCCAAACCTTAA | 96 | 2696 |
| 970243 | N/A | N/A | 11946 | 11961 | ACACAAGTCTTAGGTG | 253 | 2697 |
| 970253 | N/A | N/A | 12007 | 12022 | TCAGAAATCACGAGGT | 57 | 2698 |
| 970263 | N/A | N/A | 12213 | 12228 | TAATCTGTATCATGCA | 78 | 2699 |
| 970273 | N/A | N/A | 12293 | 12308 | AGCTGCCACTGGTAAC | 100 | 2700 |
| 970283 | N/A | N/A | 12676 | 12691 | GGCCTTAATGGTGATT | 116 | 2701 |
| 970293 | N/A | N/A | 12929 | 12944 | GAAATGAACCCTAAGT | 105 | 2702 |

TABLE 43-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970303 | N/A | N/A | 13129 | 13144 | ACCGACTCTTTTTTTA | 102 | 2703 |
| 970313 | N/A | N/A | 13400 | 13415 | CAGAGCTCCGGAGTCA | 106 | 2704 |
| 970323 | N/A | N/A | 14015 | 14030 | GCGACTGCTGAAAACC | 104 | 2705 |
| 970333 | N/A | N/A | 14206 | 14221 | AGTACAGTCCACTCCA | 93 | 2706 |
| 970343 | N/A | N/A | 14248 | 14263 | CCAACTTATAGCACTC | 86 | 2707 |
| 970353 | N/A | N/A | 14673 | 14688 | ACAAAAACTTGGGTCA | 113 | 2708 |
| 970363 | N/A | N/A | 15188 | 15203 | GATGGGACCGCCCTGG | 113 | 2709 |
| 970373 | N/A | N/A | 15597 | 15612 | CTAGTCGCGCAAGTCT | 104 | 2710 |
| 970383 | N/A | N/A | 15852 | 15867 | CAGAATGGCGAGTTGG | 69 | 2711 |
| 970393 | N/A | N/A | 15918 | 15933 | CTTAGTCAGAATCTGT | 99 | 2712 |
| 970403 | N/A | N/A | 16174 | 16189 | TAAAATGTCACGCCCG | 100 | 2713 |
| 970413 | N/A | N/A | 16468 | 16483 | CACCAGCCATCGGCAG | 119 | 2714 |
| 970423 | N/A | N/A | 16699 | 16714 | AGTGAAGTCGGGAGAT | 92 | 2715 |
| 970433 | N/A | N/A | 16869 | 16884 | GGCTCTTGATGTGAAC | 112 | 2716 |
| 970443 | N/A | N/A | 16961 | 16976 | ATCACCGAACACACCA | 112 | 2717 |

TABLE 44

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 26 | 195 |
| 935583 | N/A | N/A | 11119 | 11134 | AGCAGTGATGTCAGGT | 16 | 2718 |
| 969845 | N/A | N/A | 4005 | 4020 | GCCAAGGAGGCGGGCC | 102 | 2719 |
| 969855 | N/A | N/A | 4294 | 4309 | ACCCAAATGTGGAGCT | 97 | 2720 |
| 969865 | N/A | N/A | 4377 | 4392 | GGAGAGGGCGACGACA | 101 | 2721 |
| 969875 | N/A | N/A | 4541 | 4556 | GAATAGGACCCCTATC | 103 | 2722 |
| 969885 | N/A | N/A | 4876 | 4891 | TCCGAGCTCGGCCCCC | 110 | 2723 |
| 969895 | N/A | N/A | 5506 | 5521 | TGCGGCTCCGGCGACG | 120 | 2724 |
| 969905 | N/A | N/A | 5670 | 5685 | AAACGAGAACGCACGG | 91 | 2725 |
| 969915 | N/A | N/A | 5766 | 5781 | CGCCGGCACAGGCGCG | 86 | 2726 |
| 969925 | N/A | N/A | 6006 | 6021 | GTGTGTGCACTCGCGC | 81 | 2727 |
| 969935 | N/A | N/A | 6269 | 6284 | AGATGCGGAGGTTCCT | 68 | 2728 |
| 969945 | N/A | N/A | 6324 | 6339 | CCTATCACTGCCAAGT | 103 | 2729 |
| 969955 | N/A | N/A | 6412 | 6427 | CATAGGTCCTTCAGAT | 105 | 2730 |
| 969965 | 414 | 429 | 6893 | 6908 | CAAAGCGCACCGCAGG | 104 | 2731 |

TABLE 44-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 969975 | N/A | N/A | 6999 | 7014 | CCCTACCTTTTTTGGC | 107 | 2732 |
| 969985 | N/A | N/A | 7186 | 7201 | GCTGAACCCCACAGGA | 100 | 2733 |
| 969995 | N/A | N/A | 7223 | 7238 | TATACATTGAGGCATA | 93 | 2734 |
| 970005 | N/A | N/A | 7579 | 7594 | GTGACATAAAGGACCC | 90 | 2735 |
| 970015 | N/A | N/A | 7641 | 7656 | AAGGTCTGAGTTGTAC | 80 | 2736 |
| 970025 | N/A | N/A | 8130 | 8145 | CCCGACCCTCCCCAAC | 135 | 2737 |
| 970035 | N/A | N/A | 8223 | 8238 | CACATGATAAGGCACT | 79 | 2738 |
| 970045 | N/A | N/A | 8387 | 8402 | CAATGGAGATACTTGT | 116 | 2739 |
| 970055 | N/A | N/A | 8493 | 8508 | GGGAATCCCTTATTAG | 100 | 2740 |
| 970065 | 647 | 662 | 9137 | 9152 | CTCCAGCTTCGGTCGA | 91 | 2741 |
| 970075 | N/A | N/A | 9280 | 9295 | AGCAATTAGCTCTTCT | 89 | 2742 |
| 970085 | N/A | N/A | 9435 | 9450 | GATCCTGAGAGTAAAC | 94 | 2743 |
| 970095 | N/A | N/A | 9583 | 9598 | AGCTCAATAATCTCCC | 94 | 2744 |
| 970105 | N/A | N/A | 9740 | 9755 | CCACAATCAGCAAGTC | 100 | 2745 |
| 970115 | N/A | N/A | 9844 | 9859 | ACCGCATTGCTAGATT | 73 | 2746 |
| 970125 | N/A | N/A | 9995 | 10010 | GCAGCCAAGGATAACC | 94 | 2747 |
| 970135 | N/A | N/A | 10127 | 10142 | TCCACTACCATATTGG | 129 | 2748 |
| 970145 | N/A | N/A | 10180 | 10195 | AGCAGTAAACGCAAGT | 73 | 2749 |
| 970155 | N/A | N/A | 10268 | 10283 | GCTTCAAGACAGGTCT | 71 | 2750 |
| 970165 | N/A | N/A | 10477 | 10492 | GCTGAGAGTTCAGGTC | 93 | 2751 |
| 970175 | N/A | N/A | 10678 | 10693 | AGCAACTAGCAGGGCA | 102 | 2752 |
| 970185 | N/A | N/A | 11001 | 11016 | TCGAATCTGCCCAAAG | 77 | 2753 |
| 970204 | N/A | N/A | 11369 | 11384 | CCAGAACTAATGTCCC | 94 | 2754 |
| 970214 | N/A | N/A | 11455 | 11470 | TATTTGTTTGCAAGCT | 70 | 2755 |
| 970224 | N/A | N/A | 11549 | 11564 | AGAGGTGCCTTCTTTA | 82 | 2756 |
| 970234 | N/A | N/A | 11749 | 11764 | CCACAACTCTCGCCTC | 109 | 2757 |
| 970244 | N/A | N/A | 11948 | 11963 | CCACACAAGTCTTAGG | 85 | 2758 |
| 970254 | N/A | N/A | 12048 | 12063 | CGAGGTGATTCTCGGG | 85 | 2759 |
| 970264 | N/A | N/A | 12222 | 12237 | GCTGATAATTAATCTG | 109 | 2760 |
| 970274 | N/A | N/A | 12373 | 12388 | CGCCCATGAGTTGAAA | 87 | 2761 |
| 970284 | N/A | N/A | 12692 | 12707 | AAAGGGTAAGCACTGA | 81 | 2762 |
| 970294 | N/A | N/A | 12991 | 13006 | ATTTAAGTCATGTGTC | 83 | 2763 |
| 970304 | N/A | N/A | 13132 | 13147 | GCCACCGACTCTTTTT | 105 | 2764 |
| 970314 | N/A | N/A | 13416 | 13431 | CGGCAGTCTGCAAACA | 76 | 2765 |
| 970324 | N/A | N/A | 14016 | 14031 | GGCGACTGCTGAAAAC | 110 | 2766 |
| 970334 | N/A | N/A | 14207 | 14222 | CAGTACAGTCCACTCC | 95 | 2767 |

TABLE 44-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970344 | N/A | N/A | 14249 | 14264 | GCCAACTTATAGCACT | 62 | 2768 |
| 970354 | N/A | N/A | 14686 | 14701 | TCTGGATGAGCTTACA | 86 | 2769 |
| 970364 | N/A | N/A | 15375 | 15390 | ATCCACTGGCACCAAG | 95 | 2770 |
| 970374 | N/A | N/A | 15599 | 15614 | TTCTAGTCGCGCAAGT | 107 | 2771 |
| 970384 | N/A | N/A | 15866 | 15881 | CTACACAGGCTAATCA | 96 | 2772 |
| 970394 | N/A | N/A | 15920 | 15935 | GACTTAGTCAGAATCT | 90 | 2773 |
| 970404 | N/A | N/A | 16176 | 16191 | AATAAAATGTCACGCC | 80 | 2774 |
| 970414 | N/A | N/A | 16610 | 16625 | CAGAATGTTTCGACAT | 86 | 2775 |
| 970424 | N/A | N/A | 16703 | 16718 | CCACAGTGAAGTCGGG | 94 | 2776 |
| 970434 | N/A | N/A | 16885 | 16900 | TTACTCCGCTGAGTGG | 104 | 2777 |
| 970444 | N/A | N/A | 16964 | 16979 | CTCATCACCGAACACA | 92 | 2778 |

TABLE 45

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 33 | 195 |
| 969846 | N/A | N/A | 4037 | 4052 | GCGCGGAGGGCAGGCG | 132 | 2779 |
| 969856 | N/A | N/A | 4298 | 4313 | AGCGACCCAAATGTGG | 102 | 2780 |
| 969866 | N/A | N/A | 4407 | 4422 | GCCCGGGAGAGCGGAG | 132 | 2781 |
| 969876 | N/A | N/A | 4637 | 4652 | CGCGGAGGACCTCGCC | 107 | 2782 |
| 969886 | N/A | N/A | 4896 | 4911 | GCGGGCACAGCCGTCC | 121 | 2783 |
| 969896 | N/A | N/A | 5530 | 5545 | AGCCGAGGCCTCCTTT | 128 | 2784 |
| 969906 | N/A | N/A | 5673 | 5688 | TGGAAACGAGAACGCA | 107 | 2785 |
| 969916 | N/A | N/A | 5774 | 5789 | AAACAGCCGCCGGCA | 109 | 2786 |
| 969926 | N/A | N/A | 6022 | 6037 | CGTAACAACGACACAC | 135 | 2787 |
| 969936 | N/A | N/A | 6272 | 6287 | GTGAGATGCGGAGGTT | 61 | 2788 |
| 969946 | N/A | N/A | 6360 | 6375 | AGCTATGCTCTAGGAA | 89 | 2789 |
| 969956 | N/A | N/A | 6414 | 6429 | CGCATAGGTCCTTCAG | 94 | 2790 |
| 969966 | 429 | 444 | 6908 | 6923 | GTCATTGCTCTTGTTC | 82 | 2791 |
| 969976 | N/A | N/A | 7004 | 7019 | AGAGCCCCTACCTTTT | 107 | 2792 |
| 969986 | N/A | N/A | 7188 | 7203 | ATGCTGAACCCCACAG | 84 | 2793 |
| 969996 | N/A | N/A | 7224 | 7239 | ATATACATTGAGGCAT | 131 | 2794 |
| 970006 | N/A | N/A | 7592 | 7607 | GCGAATGTGCCTTGTG | 88 | 2795 |

TABLE 45-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970016 | N/A | N/A | 7644 | 7659 | TACAAGGTCTGAGTTG | 106 | 2796 |
| 970026 | N/A | N/A | 8132 | 8147 | CGCCCGACCCTCCCCA | 124 | 2797 |
| 970036 | N/A | N/A | 8224 | 8239 | TCACATGATAAGGCAC | 81 | 2798 |
| 970046 | N/A | N/A | 8390 | 8405 | GGACAATGGAGATACT | 97 | 2799 |
| 970056 | N/A | N/A | 8496 | 8511 | TCAGGGAATCCCTTAT | 96 | 2800 |
| 970066 | 650 | 665 | 9140 | 9155 | TCCCTCCAGCTTCGGT | 121 | 2801 |
| 970076 | N/A | N/A | 9284 | 9299 | CATTAGCAATTAGCTC | 137 | 2802 |
| 970086 | N/A | N/A | 9437 | 9452 | TGGATCCTGAGAGTAA | 100 | 2803 |
| 970096 | N/A | N/A | 9587 | 9602 | TACCAGCTCAATAATC | 127 | 2804 |
| 970106 | N/A | N/A | 9744 | 9759 | TAATCCACAATCAGCA | 127 | 2805 |
| 970116 | N/A | N/A | 9847 | 9862 | GTTACCGCATTGCTAG | 84 | 2806 |
| 970126 | N/A | N/A | 10002 | 10017 | ACTACCTGCAGCCAAG | 96 | 2807 |
| 970136 | N/A | N/A | 10130 | 10145 | TCCTCCACTACCATAT | 113 | 2808 |
| 970146 | N/A | N/A | 10184 | 10199 | CCAGAGCAGTAAACGC | 89 | 2809 |
| 970156 | N/A | N/A | 10273 | 10288 | CCGATGCTTCAAGACA | 87 | 2810 |
| 970166 | N/A | N/A | 10489 | 10504 | GTTCACAACAGAGCTG | 116 | 2811 |
| 970176 | N/A | N/A | 10711 | 10726 | CGCCCAATCACCTTCC | 119 | 2812 |
| 970186 | N/A | N/A | 11005 | 11020 | CCCATCGAATCTGCCC | 124 | 2813 |
| 970195 | N/A | N/A | 11127 | 11142 | GAACCACAAGCAGTGA | 132 | 2814 |
| 970205 | N/A | N/A | 11371 | 11386 | GACCAGAACTAATGTC | 127 | 2815 |
| 970215 | N/A | N/A | 11468 | 11483 | CAGATTGAATCCATAT | 80 | 2816 |
| 970225 | N/A | N/A | 11553 | 11568 | GCCTAGAGGTGCCTTC | 87 | 2817 |
| 970235 | N/A | N/A | 11797 | 11812 | AAAGAGCTGGTAGGTC | 135 | 2818 |
| 970245 | N/A | N/A | 11960 | 11975 | CTCTTCAGGCACCCAC | 87 | 2819 |
| 970255 | N/A | N/A | 12052 | 12067 | CATTCGAGGTGATTCT | 89 | 2820 |
| 970265 | N/A | N/A | 12224 | 12239 | TGGCTGATAATTAATC | 105 | 2821 |
| 970275 | N/A | N/A | 12383 | 12398 | TTTAAAATATCGCCCA | 101 | 2822 |
| 970285 | N/A | N/A | 12694 | 12709 | TTAAAGGGTAAGCACT | 118 | 2823 |
| 970295 | N/A | N/A | 13039 | 13054 | ACTTGCTAAGTCTTAT | 87 | 2824 |
| 970305 | N/A | N/A | 13197 | 13212 | TGGAGAAGTCCCGTGG | 109 | 2825 |
| 970315 | N/A | N/A | 13769 | 13784 | CCTTACCTGACAAGAA | 111 | 2826 |
| 970325 | N/A | N/A | 14019 | 14034 | AGAGGCGACTGCTGAA | 119 | 2827 |
| 970335 | N/A | N/A | 14208 | 14223 | CCAGTACAGTCCACTC | 106 | 2828 |
| 970345 | N/A | N/A | 14332 | 14347 | CGCTGAATTGTCATGA | 101 | 2829 |
| 970355 | N/A | N/A | 14688 | 14703 | AATCTGGATGAGCTTA | 96 | 2830 |
| 970365 | N/A | N/A | 15410 | 15425 | TCATTAGAAAGCCCTC | 119 | 2831 |

TABLE 45-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970375 | N/A | N/A | 15602 | 15617 | AAGTTCTAGTCGCGCA | 89 | 2832 |
| 970385 | N/A | N/A | 15868 | 15883 | ACCTACACAGGCTAAT | 104 | 2833 |
| 970395 | N/A | N/A | 15986 | 16001 | GCTAACTTACAGGACT | 108 | 2834 |
| 970405 | N/A | N/A | 16252 | 16267 | AGACAAGTGCCCATCC | 99 | 2835 |
| 970415 | N/A | N/A | 16611 | 16626 | TCAGAATGTTTCGACA | 94 | 2836 |
| 970425 | N/A | N/A | 16712 | 16727 | GGTAGTAGACCACAGT | 77 | 2837 |
| 970435 | N/A | N/A | 16890 | 16905 | CACTCTTACTCCGCTG | 112 | 2838 |
| 970445 | N/A | N/A | 16966 | 16981 | CCCTCATCACCGAACA | 125 | 2839 |

TABLE 46

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 33 | 195 |
| 969847 | N/A | N/A | 4044 | 4059 | CGCAGGAGCGCGGAGG | 128 | 2840 |
| 969857 | N/A | N/A | 4302 | 4317 | TCGGAGCGACCCAAAT | 88 | 2841 |
| 969867 | N/A | N/A | 4444 | 4459 | ATTCCGCGCGCAGAGC | 121 | 2842 |
| 969877 | N/A | N/A | 4643 | 4658 | TCCACGCGCGGAGGAC | 143 | 2843 |
| 969887 | N/A | N/A | 4928 | 4943 | ACCTTCGCGGCCGGCC | 142 | 2844 |
| 969897 | N/A | N/A | 5570 | 5585 | CGCCCAGGACCCGGCT | 101 | 2845 |
| 969907 | N/A | N/A | 5705 | 5720 | CGGGAGCCCGGAGGAA | 103 | 2846 |
| 969917 | N/A | N/A | 5782 | 5797 | GAGAGACGAAAACAGC | 95 | 2847 |
| 969927 | N/A | N/A | 6112 | 6127 | GAGGAAGTCCCCTTCC | 96 | 2848 |
| 969937 | N/A | N/A | 6274 | 6289 | GAGTGAGATGCGGAGG | 45 | 2849 |
| 969947 | N/A | N/A | 6364 | 6379 | CCCCAGCTATGCTCTA | 130 | 2850 |
| 969957 | N/A | N/A | 6416 | 6431 | GGCGCATAGGTCCTTC | 107 | 2851 |
| 969967 | 446 | 461 | 6925 | 6940 | TCAACCAGTTCCTCAA | 123 | 2852 |
| 969977 | N/A | N/A | 7008 | 7023 | CAGGAGAGCCCCTACC | 108 | 2853 |
| 969987 | N/A | N/A | 7191 | 7206 | CCTATGCTGAACCCCA | 112 | 2854 |
| 969997 | N/A | N/A | 7225 | 7240 | CATATACATTGAGGCA | 80 | 2855 |
| 970007 | N/A | N/A | 7598 | 7613 | TGGCATGCGAATGTGC | 121 | 2856 |
| 970017 | N/A | N/A | 7648 | 7663 | TTTCTACAAGGTCTGA | 97 | 2857 |
| 970027 | N/A | N/A | 8135 | 8150 | ACACGCCCGACCCTCC | 96 | 2858 |
| 970037 | N/A | N/A | 8231 | 8246 | TGTGGTTTCACATGAT | 79 | 2859 |
| 970047 | N/A | N/A | 8403 | 8418 | GGAGGATCATAAAGGA | 68 | 2860 |

TABLE 46-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970057 | N/A | N/A | 8520 | 8535 | GTGCTCTTACAGCCTC | 115 | 2861 |
| 970067 | 655 | 670 | 9145 | 9160 | CGTAGTCCCTCCAGCT | 73 | 2862 |
| 970077 | N/A | N/A | 9289 | 9304 | GGCCACATTAGCAATT | 100 | 2863 |
| 970087 | N/A | N/A | 9440 | 9455 | GCATGGATCCTGAGAG | 89 | 2864 |
| 970097 | N/A | N/A | 9600 | 9615 | TTCGAGAGAAATATAC | 78 | 2865 |
| 970107 | N/A | N/A | 9748 | 9763 | CATCTAATCCACAATC | 119 | 2866 |
| 970117 | N/A | N/A | 9849 | 9864 | GAGTTACCGCATTGCT | 53 | 2867 |
| 970127 | N/A | N/A | 10004 | 10019 | TCACTACCTGCAGCCA | 94 | 2868 |
| 970137 | N/A | N/A | 10133 | 10148 | AATTCCTCCACTACCA | 141 | 2869 |
| 970147 | N/A | N/A | 10187 | 10202 | GAGCCAGAGCAGTAAA | 102 | 2870 |
| 970157 | N/A | N/A | 10275 | 10290 | TACCGATGCTTCAAGA | 103 | 2871 |
| 970167 | N/A | N/A | 10499 | 10514 | CACAAAGCGGGTTCAC | 112 | 2872 |
| 970177 | N/A | N/A | 10777 | 10792 | AGAGAGTCCGACGCAC | 118 | 2873 |
| 970187 | N/A | N/A | 11006 | 11021 | TCCCATCGAATCTGCC | 105 | 2874 |
| 970196 | N/A | N/A | 11136 | 11151 | CGGTCAGCAGAACCAC | 108 | 2875 |
| 970206 | N/A | N/A | 11377 | 11392 | ATGAGGGACCAGAACT | 94 | 2876 |
| 970216 | N/A | N/A | 11470 | 11485 | ATCAGATTGAATCCAT | 77 | 2877 |
| 970226 | N/A | N/A | 11555 | 11570 | AAGCCTAGAGGTGCCT | 71 | 2878 |
| 970236 | N/A | N/A | 11813 | 11828 | CCTCATTCACAACTAG | 95 | 2879 |
| 970246 | N/A | N/A | 11963 | 11978 | CTACTCTTCAGGCACC | 82 | 2880 |
| 970256 | N/A | N/A | 12055 | 12070 | GGCCATTCGAGGTGAT | 99 | 2881 |
| 970266 | N/A | N/A | 12229 | 12244 | GCTCATGGCTGATAAT | 117 | 2882 |
| 970276 | N/A | N/A | 12385 | 12400 | TCTTTAAAATATCGCC | 145 | 2883 |
| 970286 | N/A | N/A | 12697 | 12712 | ACATTAAAGGGTAAGC | 123 | 2884 |
| 970296 | N/A | N/A | 13042 | 13057 | AGAACTTGCTAAGTCT | 134 | 2885 |
| 970306 | N/A | N/A | 13207 | 13222 | GGTCAACACTTGGAGA | 123 | 2886 |
| 970316 | N/A | N/A | 13771 | 13786 | TGCCTTACCTGACAAG | 96 | 2887 |
| 970326 | N/A | N/A | 14023 | 14038 | TTTAAGAGGCGACTGC | 200 | 2888 |
| 970336 | N/A | N/A | 14211 | 14226 | AAACCAGTACAGTCCA | 123 | 2889 |
| 970346 | N/A | N/A | 14431 | 14446 | CCCACGCGGGAGGCTC | 123 | 2890 |
| 970356 | N/A | N/A | 14706 | 14721 | CTTTGGGCACCAAAAG | 133 | 2891 |
| 970366 | N/A | N/A | 15411 | 15426 | TTCATTAGAAAGCCCT | 122 | 2892 |
| 970376 | N/A | N/A | 15606 | 15621 | TAGTAAGTTCTAGTCG | 113 | 2893 |
| 970386 | N/A | N/A | 15878 | 15893 | CTGAGACTACACCTAC | 140 | 2894 |
| 970396 | N/A | N/A | 15991 | 16006 | TTCTAGCTAACTTACA | 118 | 2895 |
| 970406 | N/A | N/A | 16271 | 16286 | GACTGGAACATTGTTG | 141 | 2896 |

TABLE 46-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970416 | N/A | N/A | 16639 | 16654 | TGCCATGGACAAGTTT | 118 | 2897 |
| 970426 | N/A | N/A | 16717 | 16732 | CAAAAGGTAGTAGACC | 89 | 2898 |
| 970436 | N/A | N/A | 16891 | 16906 | GCACTCTTACTCCGCT | 98 | 2899 |
| 970446 | N/A | N/A | 16970 | 16985 | GAAACCCTCATCACCG | 138 | 2900 |

TABLE 47

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 23 | 195 |
| 969848 | N/A | N/A | 4047 | 4062 | CGTCGCAGGAGCGCGG | 99 | 2901 |
| 969858 | N/A | N/A | 4313 | 4328 | GCACGCAAGGCTCGGA | 93 | 2902 |
| 969868 | N/A | N/A | 4446 | 4461 | GGATTCCGCGCGCAGA | 79 | 2903 |
| 969878 | N/A | N/A | 4677 | 4692 | CGCGACTCTGTCAGTT | 92 | 2904 |
| 969888 | N/A | N/A | 4981 | 4996 | CTGCGAAGCGCGCGCG | 106 | 2905 |
| 969898 | N/A | N/A | 5600 | 5615 | GCCTTCAGCGGTTTCC | 96 | 2906 |
| 969908 | N/A | N/A | 5719 | 5734 | ACGGAGGCGGCAGACG | 109 | 2907 |
| 969918 | N/A | N/A | 5785 | 5800 | GGTGAGAGACGAAAAC | 116 | 2908 |
| 969928 | N/A | N/A | 6115 | 6130 | CCGGAGGAAGTCCCCT | 100 | 2909 |
| 969938 | N/A | N/A | 6277 | 6292 | GTAGAGTGAGATGCGG | 49 | 2910 |
| 969948 | N/A | N/A | 6397 | 6412 | TTTACACCGTTGCTCA | 97 | 2911 |
| 969958 | N/A | N/A | 6418 | 6433 | ATGGCGCATAGGTCCT | 105 | 2912 |
| 969968 | 450 | 465 | 6929 | 6944 | CCGCTCAACCAGTTCC | 112 | 2913 |
| 969978 | N/A | N/A | 7011 | 7026 | ATTCAGGAGAGCCCCT | 115 | 2914 |
| 969988 | N/A | N/A | 7193 | 7208 | CTCCTATGCTGAACCC | 91 | 2915 |
| 969998 | N/A | N/A | 7227 | 7242 | CCCATATACATTGAGG | 84 | 2916 |
| 970008 | N/A | N/A | 7603 | 7618 | ACAGATGGCATGCGAA | 81 | 2917 |
| 970018 | N/A | N/A | 7666 | 7681 | TGCTATTAAACTGATT | 103 | 2918 |
| 970028 | N/A | N/A | 8138 | 8153 | CGGACACGCCCGACCC | 93 | 2919 |
| 970038 | N/A | N/A | 8331 | 8346 | ACCAAAAGTACCACAG | 108 | 2920 |
| 970048 | N/A | N/A | 8445 | 8460 | GACTGGAGTGAACCCT | 62 | 2921 |
| 970058 | N/A | N/A | 8522 | 8537 | GGGTGCTCTTACAGCC | 102 | 2922 |
| 970068 | 677 | 692 | 9167 | 9182 | TCCGGGTGTGGCTGAT | 74 | 2923 |
| 970078 | N/A | N/A | 9310 | 9325 | CCAGGATTCGCCATGG | 87 | 2924 |

TABLE 47-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970088 | N/A | N/A | 9445 | 9460 | GCCTAGCATGGATCCT | 104 | 2925 |
| 970098 | N/A | N/A | 9605 | 9620 | CACTATTCGAGAGAAA | 70 | 2926 |
| 970108 | N/A | N/A | 9754 | 9769 | GGACCACATCTAATCC | 112 | 2927 |
| 970118 | N/A | N/A | 9852 | 9867 | CCTGAGTTACCGCATT | 76 | 2928 |
| 970128 | N/A | N/A | 10011 | 10026 | CACCTCTTCACTACCT | 100 | 2929 |
| 970138 | N/A | N/A | 10138 | 10153 | TAGCCAATTCCTCCAC | 99 | 2930 |
| 970148 | N/A | N/A | 10193 | 10208 | TCCATAGAGCCAGAGC | 80 | 2931 |
| 970158 | N/A | N/A | 10277 | 10292 | GTTACCGATGCTTCAA | 54 | 2932 |
| 970168 | N/A | N/A | 10550 | 10565 | ACTAACAGGGAGACTG | 119 | 2933 |
| 970178 | N/A | N/A | 10779 | 10794 | ACAGAGAGTCCGACGC | 108 | 2934 |
| 970188 | N/A | N/A | 11012 | 11027 | CTAAAGTCCCATCGAA | 102 | 2935 |
| 970197 | N/A | N/A | 11142 | 11157 | CTGAAACGGTCAGCAG | 97 | 2936 |
| 970207 | N/A | N/A | 11399 | 11414 | TAGGCACATCAATGTT | 88 | 2937 |
| 970217 | N/A | N/A | 11525 | 11540 | AAGATCTCCATGGTGC | 61 | 2938 |
| 970227 | N/A | N/A | 11557 | 11572 | CCAAGCCTAGAGGTGC | 79 | 2939 |
| 970237 | N/A | N/A | 11820 | 11835 | GTGCAAGCCTCATTCA | 81 | 2940 |
| 970247 | N/A | N/A | 11993 | 12008 | GTTGCCGAGATATAAA | 87 | 2941 |
| 970257 | N/A | N/A | 12085 | 12100 | AGACAGTGCGCCCCAA | 117 | 2942 |
| 970267 | N/A | N/A | 12231 | 12246 | GTGCTCATGGCTGATA | 76 | 2943 |
| 970277 | N/A | N/A | 12455 | 12470 | TAAAACTGCGCTCTCT | 114 | 2944 |
| 970287 | N/A | N/A | 12860 | 12875 | CCACATACCTGAAACG | 109 | 2945 |
| 970297 | N/A | N/A | 13056 | 13071 | GAGCATCACTATTAAG | 86 | 2946 |
| 970307 | N/A | N/A | 13216 | 13231 | CATGAGCTCGGTCAAC | 101 | 2947 |
| 970317 | N/A | N/A | 13779 | 13794 | TAACGAGGTGCCTTAC | 87 | 2948 |
| 970327 | N/A | N/A | 14026 | 14041 | TGTTTTAAGAGGCGAC | 97 | 2949 |
| 970337 | N/A | N/A | 14217 | 14232 | TGTGCAAAACCAGTAC | 120 | 2950 |
| 970347 | N/A | N/A | 14448 | 14463 | GGGTAGAGCAGCTCCC | 116 | 2951 |
| 970357 | N/A | N/A | 14710 | 14725 | TTTGCTTTGGGCACCA | 76 | 2952 |
| 970367 | N/A | N/A | 15431 | 15446 | TGCCAGTTCCTTGTGA | 102 | 2953 |
| 970377 | N/A | N/A | 15607 | 15622 | ATAGTAAGTTCTAGTC | 89 | 2954 |
| 970387 | N/A | N/A | 15880 | 15895 | ATCTGAGACTACACCT | 108 | 2955 |
| 970397 | N/A | N/A | 16095 | 16110 | ATACACACCCTCGGGC | 110 | 2956 |
| 970407 | N/A | N/A | 16274 | 16289 | ACGGACTGGAACATTG | 62 | 2957 |
| 970417 | N/A | N/A | 16640 | 16655 | ATGCCATGGACAAGTT | 82 | 2958 |
| 970427 | N/A | N/A | 16728 | 16743 | CCACGAAGATTCAAAA | 107 | 2959 |

TABLE 47-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970437 | N/A | N/A | 16894 | 16909 | TGAGCACTCTTACTCC | 106 | 2960 |
| 970447 | N/A | N/A | 16976 | 16991 | TGTTCAGAAACCCTCA | 115 | 2961 |

TABLE 48

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 27 | 195 |
| 969849 | N/A | N/A | 4081 | 4096 | CGGTTAGCTCATCCCG | 95 | 2962 |
| 969859 | N/A | N/A | 4320 | 4335 | GGCCACCGCACGCAAG | 124 | 2963 |
| 969869 | N/A | N/A | 4488 | 4503 | CGACAAGTGGCGCAGA | 98 | 2964 |
| 969879 | N/A | N/A | 4805 | 4820 | CGACACGCGCCGCTCG | 62 | 2965 |
| 969889 | N/A | N/A | 4989 | 5004 | CTTTGAGGCTGCGAAG | 98 | 2966 |
| 969899 | N/A | N/A | 5610 | 5625 | GCCCGGCCGGGCCTTC | 104 | 2967 |
| 969909 | N/A | N/A | 5725 | 5740 | CCACGGACGGAGGCGG | 106 | 2968 |
| 969919 | N/A | N/A | 5793 | 5808 | AGAGACGCGGTGAGAG | 120 | 2969 |
| 969929 | N/A | N/A | 6123 | 6138 | CCAAATTCCCGGAGGA | 125 | 2970 |
| 969939 | N/A | N/A | 6280 | 6295 | CCGGTAGAGTGAGATG | 103 | 2971 |
| 969949 | N/A | N/A | 6398 | 6413 | ATTTACACCGTTGCTC | 87 | 2972 |
| 969959 | N/A | N/A | 6420 | 6435 | GAATGGCGCATAGGTC | 74 | 2973 |
| 969969 | 454 | 469 | 6933 | 6948 | GGCTCCGCTCAACCAG | 91 | 2974 |
| 969979 | N/A | N/A | 7026 | 7041 | TGTTAGGTGACCCAAA | 98 | 2975 |
| 969989 | N/A | N/A | 7198 | 7213 | TAATTCTCCTATGCTG | 97 | 2976 |
| 969999 | N/A | N/A | 7243 | 7258 | ATTCAATGCACCCCCC | 98 | 2977 |
| 970009 | N/A | N/A | 7604 | 7619 | GACAGATGGCATGCGA | 84 | 2978 |
| 970019 | N/A | N/A | 7727 | 7742 | ATAACACGGTGTTGAC | 79 | 2979 |
| 970029 | N/A | N/A | 8140 | 8155 | GGCGGACACGCCCGAC | 93 | 2980 |
| 970039 | N/A | N/A | 8343 | 8358 | GCTAAACCTGGCACCA | 93 | 2981 |
| 970049 | N/A | N/A | 8451 | 8466 | CGAAAAGACTGGAGTG | 74 | 2982 |
| 970059 | N/A | N/A | 8784 | 8799 | GGGTTAAAGGAGTGCA | 100 | 2983 |
| 970069 | 681 | 696 | 9171 | 9186 | GATTTCCGGGTGTGGC | 25 | 2984 |
| 970079 | N/A | N/A | 9371 | 9386 | CCCCGAGCTGCACACG | 105 | 2985 |
| 970089 | N/A | N/A | 9457 | 9472 | ACGAAGGGCAGTGCCT | 105 | 2986 |
| 970099 | N/A | N/A | 9613 | 9628 | GAACACACCACTATTC | 120 | 2987 |

TABLE 48-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970109 | N/A | N/A | 9772 | 9787 | GGAACTCCCGAGGGCA | 87 | 2988 |
| 970119 | N/A | N/A | 9854 | 9869 | GGCCTGAGTTACCGCA | 92 | 2989 |
| 970129 | N/A | N/A | 10013 | 10028 | TACACCTCTTCACTAC | 118 | 2990 |
| 970139 | N/A | N/A | 10143 | 10158 | TATGTTAGCCAATTCC | 59 | 2991 |
| 970149 | N/A | N/A | 10196 | 10211 | AATTCCATAGAGCCAG | 82 | 2992 |
| 970159 | N/A | N/A | 10279 | 10294 | CTGTTACCGATGCTTC | 44 | 2993 |
| 970169 | N/A | N/A | 10558 | 10573 | TGTAACTGACTAACAG | 131 | 2994 |
| 970179 | N/A | N/A | 10783 | 10798 | CTAGACAGAGAGTCCG | 95 | 2995 |
| 970189 | N/A | N/A | 11017 | 11032 | AGTGTCTAAAGTCCCA | 58 | 2996 |
| 970198 | N/A | N/A | 11143 | 11158 | GCTGAAACGGTCAGCA | 92 | 2997 |
| 970208 | N/A | N/A | 11401 | 11416 | CTTAGGCACATCAATG | 92 | 2998 |
| 970218 | N/A | N/A | 11527 | 11542 | GTAAGATCTCCATGGT | 83 | 2999 |
| 970228 | N/A | N/A | 11566 | 11581 | GTGTGCTTGCCAAGCC | 34 | 3000 |
| 970238 | N/A | N/A | 11826 | 11841 | AAAAAGGTGCAAGCCT | 94 | 3001 |
| 970248 | N/A | N/A | 11996 | 12011 | GAGGTTGCCGAGATAT | 71 | 3002 |
| 970258 | N/A | N/A | 12094 | 12109 | AAGCGAGTCAGACAGT | 122 | 3003 |
| 970268 | N/A | N/A | 12278 | 12293 | CTGTATGGAACCCCAA | 97 | 3004 |
| 970278 | N/A | N/A | 12511 | 12526 | ATGTAAAGTCTGCTGA | 80 | 3005 |
| 970288 | N/A | N/A | 12862 | 12877 | GTCCACATACCTGAAA | 92 | 3006 |
| 970298 | N/A | N/A | 13059 | 13074 | ATAGAGCATCACTATT | 100 | 3007 |
| 970308 | N/A | N/A | 13219 | 13234 | CAGCATGAGCTCGGTC | 78 | 3008 |
| 970318 | N/A | N/A | 13786 | 13801 | TAACAGATAACGAGGT | 88 | 3009 |
| 970328 | N/A | N/A | 14054 | 14069 | TCGAGATCATAGTGCA | 71 | 3010 |
| 970338 | N/A | N/A | 14219 | 14234 | CCTGTGCAAAACCAGT | 110 | 3011 |
| 970348 | N/A | N/A | 14459 | 14474 | TGGCGAGTGGCGGGTA | 118 | 3012 |
| 970358 | N/A | N/A | 14733 | 14748 | AAGCTTAGTTATCTGG | 65 | 3013 |
| 970368 | N/A | N/A | 15573 | 15588 | AGGACACTCACAGGCG | 92 | 3014 |
| 970378 | N/A | N/A | 15614 | 15629 | CAGATTAATAGTAAGT | 112 | 3015 |
| 970388 | N/A | N/A | 15885 | 15900 | CCGTGATCTGAGACTA | 55 | 3016 |
| 970398 | N/A | N/A | 16144 | 16159 | TGACACAGGAGCCGCT | 85 | 3017 |
| 970408 | N/A | N/A | 16283 | 16298 | AGATACAAAACGGACT | 115 | 3018 |
| 970418 | N/A | N/A | 16642 | 16657 | TTATGCCATGGACAAG | 81 | 3019 |
| 970428 | N/A | N/A | 16730 | 16745 | ACCCACGAAGATTCAA | 117 | 3020 |
| 970438 | N/A | N/A | 16899 | 16914 | AGGAATGAGCACTCTT | 93 | 3021 |
| 970448 | N/A | N/A | 16984 | 16999 | AGAGACCATGTTCAGA | 88 | 3022 |
| 970608 | 1440 | 1455 | 19557 | 19572 | AGATCTGTGGTAATCT | 103 | 3023 |

TABLE 49

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 19 | 195 |
| 969850 | N/A | N/A | 4151 | 4166 | GGCAGTTGTGCCGTCT | 117 | 3024 |
| 969860 | N/A | N/A | 4342 | 4357 | AGGGACCGCGCCAGGC | 100 | 3025 |
| 969870 | N/A | N/A | 4490 | 4505 | AACGACAAGTGGCGCA | 88 | 3026 |
| 969880 | N/A | N/A | 4808 | 4823 | TCCCGACACGCGCCGC | 112 | 3027 |
| 969890 | N/A | N/A | 5006 | 5021 | CCACGAGGCCCCGGAG | 96 | 3028 |
| 969900 | N/A | N/A | 5655 | 5670 | GACGAACGCGCAAAAC | 85 | 3029 |
| 969910 | N/A | N/A | 5747 | 5762 | GCACGGAGAGGGCGAG | 96 | 3030 |
| 969920 | N/A | N/A | 5795 | 5810 | ACAGAGACGCGGTGAG | 86 | 3031 |
| 969930 | N/A | N/A | 6211 | 6226 | GGACTAAGGACAGCTG | 87 | 3032 |
| 969940 | N/A | N/A | 6283 | 6298 | TAACCGGTAGAGTGAG | 73 | 3033 |
| 969950 | N/A | N/A | 6400 | 6415 | AGATTTACACCGTTGC | 70 | 3034 |
| 969960 | N/A | N/A | 6423 | 6438 | AAAGAATGGCGCATAG | 90 | 3035 |
| 969970 | 471 | 486 | 6950 | 6965 | GTCTGAGATGTCCAGC | 93 | 3036 |
| 969980 | N/A | N/A | 7156 | 7171 | CCCACATAACTCAGGC | 116 | 3037 |
| 969990 | N/A | N/A | 7201 | 7216 | GATTAATTCTCCTATG | 119 | 3038 |
| 970000 | N/A | N/A | 7375 | 7390 | TGAGATATTCCTCTCA | 82 | 3039 |
| 970010 | N/A | N/A | 7628 | 7643 | TACAGGACAGGTAAAG | 129 | 3040 |
| 970020 | N/A | N/A | 7735 | 7750 | TAGAATGCATAACACG | 92 | 3041 |
| 970030 | N/A | N/A | 8142 | 8157 | CAGGCGGACACGCCCG | 105 | 3042 |
| 970040 | N/A | N/A | 8346 | 8361 | ATGGCTAAACCTGGCA | 78 | 3043 |
| 970050 | N/A | N/A | 8453 | 8468 | TCCGAAAAGACTGGAG | 107 | 3044 |
| 970060 | N/A | N/A | 9095 | 9110 | TGCTAAAGGAGTGCAG | 117 | 3045 |
| 970070 | 688 | 703 | 9178 | 9193 | GGTACGGGATTTCCGG | 88 | 3046 |
| 970080 | N/A | N/A | 9390 | 9405 | AGTGAGAAAACCCCCC | 92 | 3047 |
| 970090 | N/A | N/A | 9459 | 9474 | CCACGAAGGGCAGTGC | 100 | 3048 |
| 970100 | N/A | N/A | 9649 | 9664 | TTTAGTATCACCTCTA | 70 | 3049 |
| 970110 | N/A | N/A | 9795 | 9810 | AGGGAGCTCATTTTGA | 108 | 3050 |
| 970120 | N/A | N/A | 9857 | 9872 | GAAGGCCTGAGTTACC | 71 | 3051 |
| 970130 | N/A | N/A | 10022 | 10037 | AAAGAGTGGTACACCT | 90 | 3052 |
| 970140 | N/A | N/A | 10154 | 10169 | GGAGCTAGTTTTATGT | 128 | 3053 |
| 970150 | N/A | N/A | 10201 | 10216 | TTACTAATTCCATAGA | 97 | 3054 |
| 970160 | N/A | N/A | 10280 | 10295 | ACTGTTACCGATGCTT | 57 | 3055 |
| 970170 | N/A | N/A | 10561 | 10576 | CTCTGTAACTGACTAA | 84 | 3056 |
| 970180 | N/A | N/A | 10827 | 10842 | TGTCACCTGGCAACCT | 104 | 3057 |
| 970190 | N/A | N/A | 11019 | 11034 | CAAGTGTCTAAAGTCC | 97 | 3058 |

TABLE 49-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970199 | N/A | N/A | 11144 | 11159 | GGCTGAAACGGTCAGC | 127 | 3059 |
| 970209 | N/A | N/A | 11404 | 11419 | ACTCTTAGGCACATCA | 73 | 3060 |
| 970219 | N/A | N/A | 11529 | 11544 | AGGTAAGATCTCCATG | 68 | 3061 |
| 970229 | N/A | N/A | 11654 | 11669 | CCTTAAGCTATTTGGT | 886 | 3062 |
| 970239 | N/A | N/A | 11848 | 11863 | GTTACTCACGAGCACC | 117 | 3063 |
| 970249 | N/A | N/A | 11998 | 12013 | ACGAGGTTGCCGAGAT | 38 | 3064 |
| 970259 | N/A | N/A | 12098 | 12113 | CTGAAAGCGAGTCAGA | 94 | 3065 |
| 970269 | N/A | N/A | 12279 | 12294 | ACTGTATGGAACCCCA | 70 | 3066 |
| 970279 | N/A | N/A | 12513 | 12528 | TCATGTAAAGTCTGCT | 79 | 3067 |
| 970289 | N/A | N/A | 12876 | 12891 | AAAGAAGCAAGTCGGT | 102 | 3068 |
| 970299 | N/A | N/A | 13062 | 13077 | ATTATAGAGCATCACT | 106 | 3069 |
| 970309 | N/A | N/A | 13308 | 13323 | CCACATGTCCCGTGGG | 128 | 3070 |
| 970319 | N/A | N/A | 13788 | 13803 | TCTAACAGATAACGAG | 103 | 3071 |
| 970329 | N/A | N/A | 14089 | 14104 | CCTGAAAAGAGCCGCC | 103 | 3072 |
| 970339 | N/A | N/A | 14227 | 14242 | TAACTTCTCCTGTGCA | 85 | 3073 |
| 970349 | N/A | N/A | 14644 | 14659 | GTACGAGCACATGTCA | 100 | 3074 |
| 970359 | N/A | N/A | 14741 | 14756 | CTGGCCTGAAGCTTAG | 75 | 3075 |
| 970369 | N/A | N/A | 15587 | 15602 | AAGTCTACAGCCCCAG | 105 | 3076 |
| 970379 | N/A | N/A | 15668 | 15683 | GCACAGCCCTTGGTTA | 97 | 3077 |
| 970389 | N/A | N/A | 15890 | 15905 | CACTGCCGTGATCTGA | 91 | 3078 |
| 970399 | N/A | N/A | 16153 | 16168 | GAAACGAGTTGACACA | 100 | 3079 |
| 970409 | N/A | N/A | 16333 | 16348 | CGCTTGTGGATATACA | 100 | 3080 |
| 970419 | N/A | N/A | 16650 | 16665 | AGACCAATTTATGCCA | 93 | 3081 |
| 970429 | N/A | N/A | 16739 | 16754 | CAGCATTGGACCCACG | 96 | 3082 |
| 970439 | N/A | N/A | 16901 | 16916 | AGAGGAATGAGCACTC | 95 | 3083 |
| 970449 | N/A | N/A | 17002 | 17017 | TGTAGAAGCCCACAAG | 107 | 3084 |
| 970609 | 1443 | 1458 | 19560 | 19575 | GATAGATCTGTGGTAA | 78 | 3085 |

TABLE 50

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 21 | 195 |
| 969851 | N/A | N/A | 4214 | 4229 | GGAACGAAGAGCAGGG | 88 | 3086 |
| 969861 | N/A | N/A | 4344 | 4359 | GCAGGGACCGCGCCAG | 90 | 3087 |

TABLE 50-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 969871 | N/A | N/A | 4493 | 4508 | GCAAACGACAAGTGGC | 115 | 3088 |
| 969881 | N/A | N/A | 4823 | 4838 | CCGCAGCCCAAAGGCT | 96 | 3089 |
| 969891 | N/A | N/A | 5046 | 5061 | CGCACTCCGGGCACCC | 89 | 3090 |
| 969901 | N/A | N/A | 5658 | 5673 | ACGGACGAACGCGCAA | 107 | 3091 |
| 969911 | N/A | N/A | 5751 | 5766 | GGACGCACGGAGAGGG | 85 | 3092 |
| 969921 | N/A | N/A | 5799 | 5814 | AGAAACAGAGACGCGG | 89 | 3093 |
| 969931 | N/A | N/A | 6213 | 6228 | TAGGACTAAGGACAGC | 105 | 3094 |
| 969941 | N/A | N/A | 6288 | 6303 | ATTTATAACCGGTAGA | 72 | 3095 |
| 969951 | N/A | N/A | 6401 | 6416 | CAGATTTACACCGTTG | 85 | 3096 |
| 969961 | N/A | N/A | 6540 | 6555 | GCATAGGCATCCTTCC | 92 | 3097 |
| 969971 | 474 | 489 | 6953 | 6968 | CGGGTCTGAGATGTCC | 102 | 3098 |
| 969981 | N/A | N/A | 7160 | 7175 | GTGACCCACATAACTC | 93 | 3099 |
| 969991 | N/A | N/A | 7205 | 7220 | GTGTGATTAATTCTCC | 36 | 3100 |
| 970001 | N/A | N/A | 7377 | 7392 | GATGAGATATTCCTCT | 124 | 3101 |
| 970011 | N/A | N/A | 7630 | 7645 | TGTACAGGACAGGTAA | 92 | 3102 |
| 970021 | N/A | N/A | 7783 | 7798 | ACCTAACTAAATGTCA | 124 | 3103 |
| 970031 | N/A | N/A | 8149 | 8164 | ATTCCAACAGGCGGAC | 98 | 3104 |
| 970041 | N/A | N/A | 8348 | 8363 | ATATGGCTAAACCTGG | 82 | 3105 |
| 970051 | N/A | N/A | 8454 | 8469 | ATCCGAAAAGACTGGA | 120 | 3106 |
| 970061 | N/A | N/A | 9103 | 9118 | TGTGAACCTGCTAAAG | 110 | 3107 |
| 970071 | 690 | 705 | 9180 | 9195 | TTGGTACGGGATTTCC | 66 | 3108 |
| 970081 | N/A | N/A | 9412 | 9427 | TGGGATGCCACCATCC | 102 | 3109 |
| 970091 | N/A | N/A | 9466 | 9481 | TAAGATCCCACGAAGG | 91 | 3110 |
| 970101 | N/A | N/A | 9659 | 9674 | CCGTTCCTTTTTTAGT | 103 | 3111 |
| 970111 | N/A | N/A | 9834 | 9849 | TAGATTCTCCCTGCAC | 82 | 3112 |
| 970121 | N/A | N/A | 9914 | 9929 | GTTCAGTGTGTTGACC | 70 | 3113 |
| 970131 | N/A | N/A | 10100 | 10115 | TGCTGCAAATCCCTCT | 79 | 3114 |
| 970141 | N/A | N/A | 10159 | 10174 | TTTCAGGAGCTAGTTT | 92 | 3115 |
| 970151 | N/A | N/A | 10206 | 10221 | CATGGTTACTAATTCC | 75 | 3116 |
| 970161 | N/A | N/A | 10281 | 10296 | TACTGTTACCGATGCT | 63 | 3117 |
| 970171 | N/A | N/A | 10568 | 10583 | GCGCTCTCTCTGTAAC | 107 | 3118 |
| 970181 | 763 | 778 | 10828 | 10843 | CTGTCACCTGGCAACC | 89 | 3119 |
| 970191 | N/A | N/A | 11085 | 11100 | AATCACCCTGGTCACC | 99 | 3120 |
| 970200 | N/A | N/A | 11334 | 11349 | ACTTATTTGTGGCTCA | 64 | 3121 |
| 970210 | N/A | N/A | 11407 | 11422 | ATTACTCTTAGGCACA | 70 | 3122 |
| 970220 | N/A | N/A | 11531 | 11546 | GTAGGTAAGATCTCCA | 78 | 3123 |

TABLE 50-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970230 | N/A | N/A | 11656 | 11671 | AACCTTAAGCTATTTG | 49 | 3124 |
| 970240 | N/A | N/A | 11851 | 11866 | TCAGTTACTCACGAGC | 103 | 3125 |
| 970250 | N/A | N/A | 12002 | 12017 | AATCACGAGGTTGCCG | 106 | 3126 |
| 970260 | N/A | N/A | 12149 | 12164 | TTTGAGACTTAACCCA | 69 | 3127 |
| 970270 | N/A | N/A | 12281 | 12296 | TAACTGTATGGAACCC | 72 | 3128 |
| 970280 | N/A | N/A | 12590 | 12605 | CTGGATATGTGGTGTT | 70 | 3129 |
| 970290 | N/A | N/A | 12892 | 12907 | TATAACGGTGTTTCAG | 64 | 3130 |
| 970300 | N/A | N/A | 13066 | 13081 | TCCTATTATAGAGCAT | 97 | 3131 |
| 970310 | N/A | N/A | 13352 | 13367 | AACGACTCCACAGAGC | 96 | 3132 |
| 970320 | N/A | N/A | 13880 | 13895 | GCCGAAGTCAACAGGA | 117 | 3133 |
| 970330 | N/A | N/A | 14115 | 14130 | TCCAACCTTTATGATT | 103 | 3134 |
| 970340 | N/A | N/A | 14229 | 14244 | TATAACTTCTCCTGTG | 93 | 3135 |
| 970350 | N/A | N/A | 14647 | 14662 | GAAGTACGAGCACATG | 82 | 3136 |
| 970360 | N/A | N/A | 14988 | 15003 | CAGCACCGTGGTGCGA | 127 | 3137 |
| 970370 | N/A | N/A | 15589 | 15604 | GCAAGTCTACAGCCCC | 51 | 3138 |
| 970380 | N/A | N/A | 15801 | 15816 | ATAACATGAGAGTGTT | 117 | 3139 |
| 970390 | N/A | N/A | 15892 | 15907 | CACACTGCCGTGATCT | 80 | 3140 |
| 970400 | N/A | N/A | 16156 | 16171 | AAAGAAACGAGTTGAC | 86 | 3141 |
| 970410 | N/A | N/A | 16379 | 16394 | AGTAACTTGACTTGAG | 103 | 3142 |
| 970420 | N/A | N/A | 16658 | 16673 | ATGGCAAAAGACCAAT | 105 | 3143 |
| 970430 | N/A | N/A | 16746 | 16761 | TGCTTTGCAGCATTGG | 70 | 3144 |
| 970440 | N/A | N/A | 16927 | 16942 | AGCTTACTGTGATTCT | 87 | 3145 |
| 970450 | 1250 | 1265 | 17043 | 17058 | CTTGGCAGGGAGCGGC | 75 | 3146 |
| 970610 | 1445 | 1460 | 19562 | 19577 | CGGATAGATCTGTGGT | 54 | 3147 |

TABLE 51

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 28 | 195 |
| 969852 | N/A | N/A | 4219 | 4234 | CCTTAGGAACGAAGAG | 106 | 3148 |
| 969862 | N/A | N/A | 4346 | 4361 | AGGCAGGGACCGCGCC | 111 | 3149 |
| 969872 | N/A | N/A | 4495 | 4510 | CTGCAAACGACAAGTG | 118 | 3150 |
| 969882 | N/A | N/A | 4829 | 4844 | ACGCACCCGCAGCCCA | 110 | 3151 |

TABLE 51-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 969892 | N/A | N/A | 5052 | 5067 | AGGCACCGCACTCCGG | 113 | 3152 |
| 969902 | N/A | N/A | 5661 | 5676 | CGCACGGACGAACGCG | 117 | 3153 |
| 969912 | N/A | N/A | 5753 | 5768 | GCGGACGCACGGAGAG | 109 | 3154 |
| 969922 | N/A | N/A | 5878 | 5893 | GCTAGCAGGAGCGAGA | 105 | 3155 |
| 969932 | N/A | N/A | 6215 | 6230 | CCTAGGACTAAGGACA | 103 | 3156 |
| 969942 | N/A | N/A | 6291 | 6306 | GGTATTTATAACCGGT | 90 | 3157 |
| 969952 | N/A | N/A | 6402 | 6417 | TCAGATTTACACCGTT | 86 | 3158 |
| 969962 | N/A | N/A | 6543 | 6558 | GTTGCATAGGCATCCT | 73 | 3159 |
| 969972 | 483 | 498 | 6962 | 6977 | CACTTTGTACGGGTCT | 89 | 3160 |
| 969982 | N/A | N/A | 7164 | 7179 | ACTTGTGACCCACATA | 104 | 3161 |
| 969992 | N/A | N/A | 7207 | 7222 | CAGTGTGATTAATTCT | 83 | 3162 |
| 970002 | N/A | N/A | 7563 | 7578 | CGCCAGCCAGATGTTT | 115 | 3163 |
| 970012 | N/A | N/A | 7632 | 7647 | GTTGTACAGGACAGGT | 67 | 3164 |
| 970022 | N/A | N/A | 7792 | 7807 | CAGGAACTGACCTAAC | 107 | 3165 |
| 970032 | N/A | N/A | 8152 | 8167 | CATATTCCAACAGGCG | 101 | 3166 |
| 970042 | N/A | N/A | 8351 | 8366 | GTCATATGGCTAAACC | 77 | 3167 |
| 970052 | N/A | N/A | 8478 | 8493 | GACTGACAGCCGAAGC | 73 | 3168 |
| 970062 | 626 | 641 | 9116 | 9131 | GGCATCATGTAGTTGT | 101 | 3169 |
| 970072 | 693 | 708 | 9183 | 9198 | ACATTGGTACGGGATT | 98 | 3170 |
| 970082 | N/A | N/A | 9420 | 9435 | CTTGGCTGTGGGATGC | 79 | 3171 |
| 970092 | N/A | N/A | 9469 | 9484 | AAATAAGATCCCACGA | 107 | 3172 |
| 970102 | N/A | N/A | 9668 | 9683 | GGTATTTTCCGTTCC | 70 | 3173 |
| 970112 | N/A | N/A | 9836 | 9851 | GCTAGATTCTCCCTGC | 113 | 3174 |
| 970122 | N/A | N/A | 9922 | 9937 | TCCAAAGGGTTCAGTG | 93 | 3175 |
| 970132 | N/A | N/A | 10104 | 10119 | CCCTTGCTGCAAATCC | 104 | 3176 |
| 970142 | N/A | N/A | 10173 | 10188 | AACGCAAGTCTGAATT | 97 | 3177 |
| 970152 | N/A | N/A | 10209 | 10224 | TCCCATGGTTACTAAT | 110 | 3178 |
| 970162 | N/A | N/A | 10286 | 10301 | TCATTTACTGTTACCG | 44 | 3179 |
| 970172 | 769 | 784 | 10604 | 10619 | AACGAGCCAGTGCACA | 101 | 3180 |
| 970182 | N/A | N/A | 10834 | 10849 | AGGTTCCTGTCACCTG | 107 | 3181 |
| 970192 | N/A | N/A | 11095 | 11110 | GGTGCTCCTAAATCAC | 101 | 3182 |
| 970201 | N/A | N/A | 11335 | 11350 | GACTTATTTGTGGCTC | 80 | 3183 |
| 970211 | N/A | N/A | 11410 | 11425 | TGTATTACTCTTAGGC | 35 | 3184 |
| 970221 | N/A | N/A | 11538 | 11553 | CTTTATAGTAGGTAAG | 101 | 3185 |
| 970231 | N/A | N/A | 11658 | 11673 | CAAACCTTAAGCTATT | 66 | 3186 |
| 970241 | N/A | N/A | 11928 | 11943 | CAAGACAAGGGTTTGA | 103 | 3187 |

TABLE 51-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970251 | N/A | N/A | 12003 | 12018 | AAATCACGAGGTTGCC | 79 | 3188 |
| 970261 | N/A | N/A | 12208 | 12223 | TGTATCATGCATACCA | 97 | 3189 |
| 970271 | N/A | N/A | 12285 | 12300 | CTGGTAACTGTATGGA | 83 | 3190 |
| 970281 | N/A | N/A | 12591 | 12606 | ACTGGATATGTGGTGT | 90 | 3191 |
| 970291 | N/A | N/A | 12894 | 12909 | AATATAACGGTGTTTC | 92 | 3192 |
| 970301 | N/A | N/A | 13111 | 13126 | GAACAAGTGTATCTTT | 95 | 3193 |
| 970311 | N/A | N/A | 13370 | 13385 | GGACACCACCTCGAGG | 99 | 3194 |
| 970321 | N/A | N/A | 13912 | 13927 | TCTACTGGAGTCAAGC | 70 | 3195 |
| 970331 | N/A | N/A | 14194 | 14209 | TCCACCCTCCGTCTCA | 109 | 3196 |
| 970341 | N/A | N/A | 14231 | 14246 | CCTATAACTTCTCCTG | 107 | 3197 |
| 970351 | N/A | N/A | 14650 | 14665 | CCAGAAGTACGAGCAC | 103 | 3198 |
| 970361 | N/A | N/A | 14990 | 15005 | TGCAGCACCGTGGTGC | 101 | 3199 |
| 970371 | N/A | N/A | 15592 | 15607 | CGCGCAAGTCTACAGC | 87 | 3200 |
| 970381 | N/A | N/A | 15812 | 15827 | TCCAACCCTAGATAAC | 105 | 3201 |
| 970391 | N/A | N/A | 15894 | 15909 | TTCACACTGCCGTGAT | 112 | 3202 |
| 970401 | N/A | N/A | 16161 | 16176 | CCGCAAAAGAAACGAG | 107 | 3203 |
| 970411 | N/A | N/A | 16386 | 16401 | ATGGAACAGTAACTTG | 97 | 3204 |
| 970421 | N/A | N/A | 16666 | 16681 | GTCACGCAATGGCAAA | 102 | 3205 |
| 970431 | N/A | N/A | 16770 | 16785 | AACTAGTCGACAGCTA | 107 | 3206 |
| 970441 | N/A | N/A | 16933 | 16948 | AGCAAGAGCTTACTGT | 106 | 3207 |
| 970451 | 1254 | 1269 | 17047 | 17062 | GAATCTTGGCAGGGAG | 100 | 3208 |
| 970611 | 1451 | 1466 | 19568 | 19583 | GAATGGCGGATAGATC | 103 | 3209 |

TABLE 52

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 609408 | 4226 | 4241 | 22343 | 22358 | TTGTAAATGAGTCGGT | 27 | 195 |
| 969853 | N/A | N/A | 4221 | 4236 | CCCCTTAGGAACGAAG | 106 | 3210 |
| 969863 | N/A | N/A | 4362 | 4377 | AGCTGCGGAGCCTGGG | 69 | 3211 |
| 969873 | N/A | N/A | 4499 | 4514 | GGCTCTGCAAACGACA | 100 | 3212 |
| 969883 | N/A | N/A | 4833 | 4848 | TGTAACGCACCCGCAG | 104 | 3213 |
| 969893 | N/A | N/A | 5464 | 5479 | GTCCGCCCCGCGCGGT | 97 | 3214 |
| 969903 | N/A | N/A | 5665 | 5680 | AGAACGCACGGACGAA | 99 | 3215 |
| 969913 | N/A | N/A | 5756 | 5771 | GGCGCGGACGCACGGA | 90 | 3216 |

TABLE 52-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 969923 | N/A | N/A | 5996 | 6011 | TCGCGCAAAGGGCAAG | 104 | 3217 |
| 969933 | N/A | N/A | 6264 | 6279 | CGGAGGTTCCTTGAGG | 58 | 3218 |
| 969943 | N/A | N/A | 6293 | 6308 | TGGGTATTTATAACCG | 96 | 3219 |
| 969953 | N/A | N/A | 6405 | 6420 | CCTTCAGATTTACACC | 109 | 3220 |
| 969963 | N/A | N/A | 6545 | 6560 | ATGTTGCATAGGCATC | 90 | 3221 |
| 969973 | 489 | 504 | 6968 | 6983 | CCTGTACACTTTGTAC | 102 | 3222 |
| 969983 | N/A | N/A | 7167 | 7182 | TCAACTTGTGACCCAC | 86 | 3223 |
| 969993 | N/A | N/A | 7216 | 7231 | TGAGGCATACAGTGTG | 82 | 3224 |
| 970003 | N/A | N/A | 7575 | 7590 | CATAAAGGACCCCGCC | 105 | 3225 |
| 970013 | N/A | N/A | 7636 | 7651 | CTGAGTTGTACAGGAC | 45 | 3226 |
| 970023 | N/A | N/A | 8100 | 8115 | AATGGCAGCACCGTGT | 100 | 3227 |
| 970033 | N/A | N/A | 8216 | 8231 | TAAGGCACTACTTCCA | 90 | 3228 |
| 970043 | N/A | N/A | 8382 | 8397 | GAGATACTTGTACTGT | 51 | 3229 |
| 970053 | N/A | N/A | 8480 | 8495 | TAGACTGACAGCCGAA | 97 | 3230 |
| 970063 | 630 | 645 | 9120 | 9135 | GGGTGGCATCATGTAG | 73 | 3231 |
| 970073 | 699 | 714 | 9189 | 9204 | CATGGGACATTGGTAC | 82 | 3232 |
| 970083 | N/A | N/A | 9429 | 9444 | GAGAGTAAACTTGGCT | 88 | 3233 |
| 970093 | N/A | N/A | 9552 | 9567 | TATTTATGAGCTTCCA | 79 | 3234 |
| 970103 | N/A | N/A | 9671 | 9686 | CATGGTATTTTTCCGT | 62 | 3235 |
| 970113 | N/A | N/A | 9838 | 9853 | TTGCTAGATTCTCCCT | 84 | 3236 |
| 970123 | N/A | N/A | 9927 | 9942 | AAACATCCAAAGGGTT | 101 | 3237 |
| 970133 | N/A | N/A | 10106 | 10121 | AGCCCTTGCTGCAAAT | 111 | 3238 |
| 970143 | N/A | N/A | 10176 | 10191 | GTAAACGCAAGTCTGA | 86 | 3239 |
| 970153 | N/A | N/A | 10212 | 10227 | CTTTCCCATGGTTACT | 92 | 3240 |
| 970163 | N/A | N/A | 10306 | 10321 | CACCTGATCTTGCTGC | 88 | 3241 |
| 970173 | N/A | N/A | 10613 | 10628 | TGATGGAGAAACGAGC | 102 | 3242 |
| 970183 | 772 | 787 | 10837 | 10852 | AAAAGGTTCCTGTCAC | 105 | 3243 |
| 970193 | N/A | N/A | 11100 | 11115 | CTAATGGTGCTCCTAA | 96 | 3244 |
| 970202 | N/A | N/A | 11338 | 11353 | GAGGACTTATTTGTGG | 78 | 3245 |
| 970212 | N/A | N/A | 11412 | 11427 | TGTGTATTACTCTTAG | 25 | 3246 |
| 970222 | N/A | N/A | 11539 | 11554 | TCTTTATAGTAGGTAA | 86 | 3247 |
| 970232 | N/A | N/A | 11662 | 11677 | ATTCCAAACCTTAAGC | 101 | 3248 |
| 970242 | N/A | N/A | 11931 | 11946 | GTTCAAGACAAGGGTT | 85 | 3249 |
| 970252 | N/A | N/A | 12006 | 12021 | CAGAAATCACGAGGTT | 75 | 3250 |
| 970262 | N/A | N/A | 12211 | 12226 | ATCTGTATCATGCATA | 76 | 3251 |
| 970272 | N/A | N/A | 12291 | 12306 | CTGCCACTGGTAACTG | 79 | 3252 |

TABLE 52-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | IRF4 (% UTC) | SEQ ID NO |
|---|---|---|---|---|---|---|---|
| 970282 | N/A | N/A | 12657 | 12672 | GGGTGGTAGAATGTGA | 67 | 3253 |
| 970292 | N/A | N/A | 12926 | 12941 | ATGAACCCTAAGTTTA | 104 | 3254 |
| 970302 | N/A | N/A | 13114 | 13129 | AAGGAACAAGTGTATC | 87 | 3255 |
| 970312 | N/A | N/A | 13395 | 13410 | CTCCGGAGTCAGTGCT | 99 | 3256 |
| 970322 | N/A | N/A | 13961 | 13976 | GACCATCTGATCCGGA | 98 | 3257 |
| 970332 | N/A | N/A | 14203 | 14218 | ACAGTCCACTCCACCC | 86 | 3258 |
| 970342 | N/A | N/A | 14245 | 14260 | ACTTATAGCACTCTCC | 99 | 3259 |
| 970352 | N/A | N/A | 14669 | 14684 | AAACTTGGGTCACTTA | 95 | 3260 |
| 970362 | N/A | N/A | 15148 | 15163 | CTTAGAATGAGAGGTG | 99 | 3261 |
| 970372 | N/A | N/A | 15595 | 15610 | AGTCGCGCAAGTCTAC | 100 | 3262 |
| 970382 | N/A | N/A | 15846 | 15861 | GGCGAGTTGGCACAAT | 51 | 3263 |
| 970392 | N/A | N/A | 15896 | 15911 | CATTCACACTGCCGTG | 94 | 3264 |
| 970402 | N/A | N/A | 16163 | 16178 | GCCCGCAAAAGAAACG | 98 | 3265 |
| 970412 | N/A | N/A | 16416 | 16431 | TCTGAGTAGACTTCTT | 86 | 3266 |
| 970422 | N/A | N/A | 16670 | 16685 | CGTAGTCACGCAATGG | 85 | 3267 |
| 970432 | N/A | N/A | 16772 | 16787 | GGAACTAGTCGACAGC | 82 | 3268 |
| 970442 | N/A | N/A | 16958 | 16973 | ACCGAACACACCAGGT | 114 | 3269 |
| 970452 | 1277 | 1292 | 17070 | 17085 | TCTCCAAAGCATAGAG | 108 | 3270 |
| 970612 | 1465 | 1480 | 19582 | 19597 | ATTCTTGAATAGAGGA | 84 | 3271 |

Example 10: Effect of Mixed MOE and cEt Gapmers with Phosphorothioate Internucleoside Linkages on Human IRF4 In Vitro, Single Dose Modified oligonucleotides complementary to a human IRF4 nucleic acid were designed and tested for their effect on IRF4 mRNA in vitro.

Cultured MM.1R cells at a density of 5,000 cells per well were transfected by free uptake with 1,000 nM concentration of modified oligonucleotide or no modified oligonucleotide for untreated controls. After approximately 24 hours, RNA was isolated from the cells and IRF4 mRNA levels were measured by quantitative real-time PCR. Human primer probe set hIRF4_LTS34726 (described hereinabove in Example 7) was used to measure mRNA levels. IRF4 mRNA levels were adjusted according to total RNA content, as measured by RIBOGREEN®. Results are presented in the tables below as percent control of the amount of IRF4 mRNA, relative to untreated control (UTC) cells.

The modified oligonucleotides in Tables 53 through 58 are cEt and/or MOE containing gapmers. The modified oligonucleotides have a central gap segment comprising 2'-deoxynucleosides which is flanked by wing segments on the 5' direction and the 3' direction. At least one nucleoside in the 5' wing segment and/or one nucleoside in the 3' wing segment has a MOE and/or cEt sugar modification. The "Motif" column describes the sugar modifications of each oligonucleotide. "k" indicates a cEt sugar modification; "d" indicates deoxyribose; and "e" indicates a MOE modification. Each internucleoside linkage is a phosphorothioate internucleoside linkage and each cytosine residue is a 5-methylcytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Tables 53 through 58 below is complementary to human IRF4 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to human IRF4 reduced the amount of human IRF4 mRNA.

TABLE 53

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 13 | 195 |
| 881450 | 3252 | 3267 | 21369 | 21384 | ACACTTTTAGAGAGGA | kkk-d10-kkk | 27 | 2111 |
| 881659 | 4592 | 4607 | 22709 | 22724 | GGAAGTTTACACTGGA | kkk-d10-kkk | 4 | 2044 |
| 1013023 | N/A | N/A | 10142 | 10157 | ATGTTAGCCAATTCCT | k-d10-kekek | 100 | 3272 |
| 1013024 | N/A | N/A | 10143 | 10158 | TATGTTAGCCAATTCC | k-d10-kekek | 99 | 2991 |
| 1013025 | N/A | N/A | 10144 | 10159 | TTATGTTAGCCAATTC | k-d10-kekek | 98 | 3273 |
| 1013026 | N/A | N/A | 10145 | 10160 | TTTATGTTAGCCAATT | k-d10-kekek | 100 | 3274 |
| 1013032 | N/A | N/A | 10278 | 10293 | TGTTACCGATGCTTCA | k-d10-kekek | 74 | 2294 |
| 1013033 | N/A | N/A | 10279 | 10294 | CTGTTACCGATGCTTC | k-d10-kekek | 64 | 2993 |
| 1013034 | N/A | N/A | 10280 | 10295 | ACTGTTACCGATGCTT | k-d10-kekek | 80 | 3055 |
| 1013035 | N/A | N/A | 10281 | 10296 | TACTGTTACCGATGCT | k-d10-kekek | 90 | 3117 |
| 1013046 | N/A | N/A | 11016 | 11031 | GTGTCTAAAGTCCCAT | k-d10-kekek | 66 | 3275 |
| 1013047 | N/A | N/A | 11017 | 11032 | AGTGTCTAAAGTCCCA | k-d10-kekek | 101 | 2996 |
| 1013048 | N/A | N/A | 11018 | 11033 | AAGTGTCTAAAGTCCC | k-d10-kekek | 101 | 3276 |
| 1013049 | N/A | N/A | 11019 | 11034 | CAAGTGTCTAAAGTCC | k-d10-kekek | 93 | 3058 |
| 1013053 | N/A | N/A | 11119 | 11134 | AGCAGTGATGTCAGGT | k-d10-kekek | 23 | 2718 |
| 1013054 | N/A | N/A | 11120 | 11135 | AAGCAGTGATGTCAGG | k-d10-kekek | 72 | 3277 |
| 1013055 | N/A | N/A | 11121 | 11136 | CAAGCAGTGATGTCAG | k-d10-kekek | 65 | 3278 |
| 1013060 | N/A | N/A | 11395 | 11410 | CACATCAATGTTTTAG | k-d10-kekek | 55 | 3279 |
| 1013061 | N/A | N/A | 11396 | 11411 | GCACATCAATGTTTTA | k-d10-kekek | 87 | 1159 |
| 1013062 | N/A | N/A | 11397 | 11412 | GGCACATCAATGTTTT | k-d10-kekek | 72 | 3280 |
| 1013063 | N/A | N/A | 11398 | 11413 | AGGCACATCAATGTTT | k-d10-kekek | 95 | 1233 |
| 1013074 | N/A | N/A | 11411 | 11426 | GTGTATTACTCTTAGG | k-d10-kekek | 16 | 1540 |
| 1013075 | N/A | N/A | 11412 | 11427 | TGTGTATTACTCTTAG | k-d10-kekek | 42 | 3246 |
| 1013076 | N/A | N/A | 11413 | 11428 | ATGTGTATTACTCTTA | k-d10-kekek | 83 | 3281 |
| 1013077 | N/A | N/A | 11414 | 11429 | AATGTGTATTACTCTT | k-d10-kekek | 76 | 3282 |
| 1013090 | N/A | N/A | 11565 | 11580 | TGTGCTTGCCAAGCCT | k-d10-kekek | 101 | 3283 |
| 1013091 | N/A | N/A | 11566 | 11581 | GTGTGCTTGCCAAGCC | k-d10-kekek | 60 | 3000 |
| 1013092 | N/A | N/A | 11567 | 11582 | CGTGTGCTTGCCAAGC | k-d10-kekek | 70 | 3284 |
| 1013093 | N/A | N/A | 11568 | 11583 | ACGTGTGCTTGCCAAG | k-d10-kekek | 53 | 3285 |
| 1013125 | N/A | N/A | 12514 | 12529 | TTCATGTAAAGTCTGC | k-d10-kekek | 98 | 3286 |
| 1013126 | N/A | N/A | 12515 | 12530 | GTTCATGTAAAGTCTG | k-d10-kekek | 55 | 934 |
| 1013127 | N/A | N/A | 12516 | 12531 | AGTTCATGTAAAGTCT | k-d10-kekek | 75 | 755 |
| 1013128 | N/A | N/A | 12517 | 12532 | AAGTTCATGTAAAGTC | k-d10-kekek | 86 | 3287 |
| 1013462 | N/A | N/A | 10142 | 10157 | ATGTTAGCCAATTCCT | kk-d9-kekek | 72 | 3272 |
| 1013463 | N/A | N/A | 10143 | 10158 | TATGTTAGCCAATTCC | kk-d9-kekek | 92 | 2991 |
| 1013464 | N/A | N/A | 10144 | 10159 | TTATGTTAGCCAATTC | kk-d9-kekek | 89 | 3273 |

TABLE 53-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 1013465 | N/A | N/A | 10145 | 10160 | TTTATGTTAGCCAATT | kk-d9-kekek | 91 | 3274 |
| 1013471 | N/A | N/A | 10278 | 10293 | TGTTACCGATGCTTCA | kk-d9-kekek | 72 | 2294 |
| 1013472 | N/A | N/A | 10279 | 10294 | CTGTTACCGATGCTTC | kk-d9-kekek | 48 | 2993 |
| 1013473 | N/A | N/A | 10280 | 10295 | ACTGTTACCGATGCTT | kk-d9-kekek | 70 | 3055 |
| 1013474 | N/A | N/A | 10281 | 10296 | TACTGTTACCGATGCT | kk-d9-kekek | 91 | 3117 |
| 1013485 | N/A | N/A | 11016 | 11031 | GTGTCTAAAGTCCCAT | kk-d9-kekek | 87 | 3275 |
| 1013486 | N/A | N/A | 11017 | 11032 | AGTGTCTAAAGTCCCA | kk-d9-kekek | 74 | 2996 |
| 1013487 | N/A | N/A | 11018 | 11033 | AAGTGTCTAAAGTCCC | kk-d9-kekek | 88 | 3276 |
| 1013488 | N/A | N/A | 11019 | 11034 | CAAGTGTCTAAAGTCC | kk-d9-kekek | 85 | 3058 |
| 1013492 | N/A | N/A | 11119 | 11134 | AGCAGTGATGTCAGGT | kk-d9-kekek | 34 | 2718 |
| 1013493 | N/A | N/A | 11120 | 11135 | AAGCAGTGATGTCAGG | kk-d9-kekek | 57 | 3277 |
| 1013494 | N/A | N/A | 11121 | 11136 | CAAGCAGTGATGTCAG | kk-d9-kekek | 49 | 3278 |
| 1013499 | N/A | N/A | 11395 | 11410 | CACATCAATGTTTTAG | kk-d9-kekek | 81 | 3279 |
| 1013500 | N/A | N/A | 11396 | 11411 | GCACATCAATGTTTTA | kk-d9-kekek | 82 | 1159 |
| 1013501 | N/A | N/A | 11397 | 11412 | GGCACATCAATGTTTT | kk-d9-kekek | 77 | 3280 |
| 1013502 | N/A | N/A | 11398 | 11413 | AGGCACATCAATGTTT | kk-d9-kekek | 84 | 1233 |
| 1013513 | N/A | N/A | 11411 | 11426 | GTGTATTACTCTTAGG | kk-d9-kekek | 14 | 1540 |
| 1013514 | N/A | N/A | 11412 | 11427 | TGTGTATTACTCTTAG | kk-d9-kekek | 13 | 3246 |
| 1013515 | N/A | N/A | 11413 | 11428 | ATGTGTATTACTCTTA | kk-d9-kekek | 46 | 3281 |
| 1013516 | N/A | N/A | 11414 | 11429 | AATGTGTATTACTCTT | kk-d9-kekek | 48 | 3282 |
| 1013529 | N/A | N/A | 11565 | 11580 | TGTGCTTGCCAAGCCT | kk-d9-kekek | 98 | 3283 |

TABLE 54

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 11 | 195 |
| 881450 | 3252 | 3267 | 21369 | 21384 | ACACTTTTAGAGAGGA | kkk-d10-kkk | 27 | 2111 |
| 881659 | 4592 | 4607 | 22709 | 22724 | GGAAGTTTACACTGGA | kkk-d10-kkk | 3 | 2044 |
| 1013530 | N/A | N/A | 11566 | 11581 | GTGTGCTTGCCAAGCC | kk-d9-kekek | 59 | 3000 |
| 1013531 | N/A | N/A | 11567 | 11582 | CGTGTGCTTGCCAAGC | kk-d9-kekek | 51 | 3284 |
| 1013532 | N/A | N/A | 11568 | 11583 | ACGTGTGCTTGCCAAG | kk-d9-kekek | 51 | 3285 |
| 1013564 | N/A | N/A | 12514 | 12529 | TTCATGTAAAGTCTGC | kk-d9-kekek | 90 | 3286 |
| 1013565 | N/A | N/A | 12515 | 12530 | GTTCATGTAAAGTCTG | kk-d9-kekek | 58 | 934 |
| 1013566 | N/A | N/A | 12516 | 12531 | AGTTCATGTAAAGTCT | kk-d9-kekek | 58 | 755 |

TABLE 54-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 1013567 | N/A | N/A | 12517 | 12532 | AAGTTCATGTAAAGTC | kk-d9-kekek | 66 | 3287 |
| 1013902 | N/A | N/A | 10142 | 10157 | ATGTTAGCCAATTCCT | kk-d10-keke | 80 | 3272 |
| 1013903 | N/A | N/A | 10143 | 10158 | TATGTTAGCCAATTCC | kk-d10-keke | 92 | 2991 |
| 1013904 | N/A | N/A | 10144 | 10159 | TTATGTTAGCCAATTC | kk-d10-keke | 89 | 3273 |
| 1013905 | N/A | N/A | 10145 | 10160 | TTTATGTTAGCCAATT | kk-d10-keke | 89 | 3274 |
| 1013911 | N/A | N/A | 10278 | 10293 | TGTTACCGATGCTTCA | kk-d10-keke | 75 | 2294 |
| 1013912 | N/A | N/A | 10279 | 10294 | CTGTTACCGATGCTTC | kk-d10-keke | 57 | 2993 |
| 1013913 | N/A | N/A | 10280 | 10295 | ACTGTTACCGATGCTT | kk-d10-keke | 70 | 3055 |
| 1013914 | N/A | N/A | 10281 | 10296 | TACTGTTACCGATGCT | kk-d10-keke | 76 | 3117 |
| 1013925 | N/A | N/A | 11016 | 11031 | GTGTCTAAAGTCCCAT | kk-d10-keke | 91 | 3275 |
| 1013926 | N/A | N/A | 11017 | 11032 | AGTGTCTAAAGTCCCA | kk-d10-keke | 68 | 2996 |
| 1013927 | N/A | N/A | 11018 | 11033 | AAGTGTCTAAAGTCCC | kk-d10-keke | 90 | 3276 |
| 1013928 | N/A | N/A | 11019 | 11034 | CAAGTGTCTAAAGTCC | kk-d10-keke | 84 | 3058 |
| 1013932 | N/A | N/A | 11119 | 11134 | AGCAGTGATGTCAGGT | kk-d10-keke | 33 | 2718 |
| 1013933 | N/A | N/A | 11120 | 11135 | AAGCAGTGATGTCAGG | kk-d10-keke | 26 | 3277 |
| 1013934 | N/A | N/A | 11121 | 11136 | CAAGCAGTGATGTCAG | kk-d10-keke | 80 | 3278 |
| 1013939 | N/A | N/A | 11395 | 11410 | CACATCAATGTTTTAG | kk-d10-keke | 75 | 3279 |
| 1013940 | N/A | N/A | 11396 | 11411 | GCACATCAATGTTTTA | kk-d10-keke | 51 | 1159 |
| 1013941 | N/A | N/A | 11397 | 11412 | GGCACATCAATGTTTT | kk-d10-keke | 91 | 3280 |
| 1013942 | N/A | N/A | 11398 | 11413 | AGGCACATCAATGTTT | kk-d10-keke | 84 | 1233 |
| 1013953 | N/A | N/A | 11411 | 11426 | GTGTATTACTCTTAGG | kk-d10-keke | 22 | 1540 |
| 1013954 | N/A | N/A | 11412 | 11427 | TGTGTATTACTCTTAG | kk-d10-keke | 49 | 3246 |
| 1013955 | N/A | N/A | 11413 | 11428 | ATGTGTATTACTCTTA | kk-d10-keke | 53 | 3281 |
| 1013956 | N/A | N/A | 11414 | 11429 | AATGTGTATTACTCTT | kk-d10-keke | 92 | 3282 |
| 1013969 | N/A | N/A | 11565 | 11580 | TGTGCTTGCCAAGCCT | kk-d10-keke | 74 | 3283 |
| 1013970 | N/A | N/A | 11566 | 11581 | GTGTGCTTGCCAAGCC | kk-d10-keke | 63 | 3000 |
| 1013971 | N/A | N/A | 11567 | 11582 | CGTGTGCTTGCCAAGC | kk-d10-keke | 45 | 3284 |
| 1013972 | N/A | N/A | 11568 | 11583 | ACGTGTGCTTGCCAAG | kk-d10-keke | 94 | 3285 |
| 1014004 | N/A | N/A | 12514 | 12529 | TTCATGTAAAGTCTGC | kk-d10-keke | 51 | 3286 |
| 1014005 | N/A | N/A | 12515 | 12530 | GTTCATGTAAAGTCTG | kk-d10-keke | 69 | 934 |
| 1014006 | N/A | N/A | 12516 | 12531 | AGTTCATGTAAAGTCT | kk-d10-keke | 55 | 755 |
| 1014007 | N/A | N/A | 12517 | 12532 | AAGTTCATGTAAAGTC | kk-d10-keke | 72 | 3287 |

TABLE 55

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 9 | 195 |
| 881450 | 3252 | 3267 | 21369 | 21384 | ACACTTTTAGAGAGGA | kkk-d10-kkk | 17 | 2111 |
| 881659 | 4592 | 4607 | 22709 | 22724 | GGAAGTTTACACTGGA | kkk-d10-kkk | 2 | 2044 |
| 1014342 | N/A | N/A | 10142 | 10157 | ATGTTAGCCAATTCCT | kk-d9-kdkdk | 70 | 3272 |
| 1014343 | N/A | N/A | 10143 | 10158 | TATGTTAGCCAATTCC | kk-d9-kdkdk | 98 | 2991 |
| 1014344 | N/A | N/A | 10144 | 10159 | TTATGTTAGCCAATTC | kk-d9-kdkdk | 83 | 3273 |
| 1014345 | N/A | N/A | 10145 | 10160 | TTTATGTTAGCCAATT | kk-d9-kdkdk | 89 | 3274 |
| 1014351 | N/A | N/A | 10278 | 10293 | TGTTACCGATGCTTCA | kk-d9-kdkdk | 65 | 2294 |
| 1014352 | N/A | N/A | 10279 | 10294 | CTGTTACCGATGCTTC | kk-d9-kdkdk | 42 | 2993 |
| 1014353 | N/A | N/A | 10280 | 10295 | ACTGTTACCGATGCTT | kk-d9-kdkdk | 78 | 3055 |
| 1014354 | N/A | N/A | 10281 | 10296 | TACTGTTACCGATGCT | kk-d9-kdkdk | 93 | 3117 |
| 1014365 | N/A | N/A | 11016 | 11031 | GTGTCTAAAGTCCCAT | kk-d9-kdkdk | 80 | 3275 |
| 1014366 | N/A | N/A | 11017 | 11032 | AGTGTCTAAAGTCCCA | kk-d9-kdkdk | 86 | 2996 |
| 1014367 | N/A | N/A | 11018 | 11033 | AAGTGTCTAAAGTCCC | kk-d9-kdkdk | 87 | 3276 |
| 1014368 | N/A | N/A | 11019 | 11034 | CAAGTGTCTAAAGTCC | kk-d9-kdkdk | 97 | 3058 |
| 1014372 | N/A | N/A | 11119 | 11134 | AGCAGTGATGTCAGGT | kk-d9-kdkdk | 45 | 2718 |
| 1014373 | N/A | N/A | 11120 | 11135 | AAGCAGTGATGTCAGG | kk-d9-kdkdk | 40 | 3277 |
| 1014374 | N/A | N/A | 11121 | 11136 | CAAGCAGTGATGTCAG | kk-d9-kdkdk | 54 | 3278 |
| 1014379 | N/A | N/A | 11395 | 11410 | CACATCAATGTTTTAG | kk-d9-kdkdk | 72 | 3279 |
| 1014380 | N/A | N/A | 11396 | 11411 | GCACATCAATGTTTTA | kk-d9-kdkdk | 89 | 1159 |
| 1014381 | N/A | N/A | 11397 | 11412 | GGCACATCAATGTTTT | kk-d9-kdkdk | 74 | 3280 |
| 1014382 | N/A | N/A | 11398 | 11413 | AGGCACATCAATGTTT | kk-d9-kdkdk | 96 | 1233 |
| 1014393 | N/A | N/A | 11411 | 11426 | GTGTATTACTCTTAGG | kk-d9-kdkdk | 11 | 1540 |
| 1014394 | N/A | N/A | 11412 | 11427 | TGTGTATTACTCTTAG | kk-d9-kdkdk | 19 | 3246 |
| 1014395 | N/A | N/A | 11413 | 11428 | ATGTGTATTACTCTTA | kk-d9-kdkdk | 56 | 3281 |
| 1014396 | N/A | N/A | 11414 | 11429 | AATGTGTATTACTCTT | kk-d9-kdkdk | 90 | 3282 |
| 1014409 | N/A | N/A | 11565 | 11580 | TGTGCTTGCCAAGCCT | kk-d9-kdkdk | 77 | 3283 |
| 1014410 | N/A | N/A | 11566 | 11581 | GTGTGCTTGCCAAGCC | kk-d9-kdkdk | 41 | 3000 |
| 1014411 | N/A | N/A | 11567 | 11582 | CGTGTGCTTGCCAAGC | kk-d9-kdkdk | 33 | 3284 |
| 1014412 | N/A | N/A | 11568 | 11583 | ACGTGTGCTTGCCAAG | kk-d9-kdkdk | 25 | 3285 |
| 1014444 | N/A | N/A | 12514 | 12529 | TTCATGTAAAGTCTGC | kk-d9-kdkdk | 86 | 3286 |
| 1014445 | N/A | N/A | 12515 | 12530 | GTTCATGTAAAGTCTG | kk-d9-kdkdk | 66 | 934 |
| 1014446 | N/A | N/A | 12516 | 12531 | AGTTCATGTAAAGTCT | kk-d9-kdkdk | 68 | 755 |
| 1014447 | N/A | N/A | 12517 | 12532 | AAGTTCATGTAAAGTC | kk-d9-kdkdk | 68 | 3287 |
| 1014783 | N/A | N/A | 10142 | 10157 | ATGTTAGCCAATTCCT | kk-d9-eeekk | 83 | 3272 |
| 1014784 | N/A | N/A | 10143 | 10158 | TATGTTAGCCAATTCC | kk-d9-eeekk | 92 | 2991 |
| 1014785 | N/A | N/A | 10144 | 10159 | TTATGTTAGCCAATTC | kk-d9-eeekk | 86 | 3273 |

TABLE 55-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 1014786 | N/A | N/A | 10145 | 10160 | TTTATGTTAGCCAATT | kk-d9-eeekk | 97 | 3274 |
| 1014792 | N/A | N/A | 10278 | 10293 | TGTTACCGATGCTTCA | kk-d9-eeekk | 69 | 2294 |
| 1014793 | N/A | N/A | 10279 | 10294 | CTGTTACCGATGCTTC | kk-d9-eeekk | 36 | 2993 |
| 1014794 | N/A | N/A | 10280 | 10295 | ACTGTTACCGATGCTT | kk-d9-eeekk | 73 | 3055 |
| 1014795 | N/A | N/A | 10281 | 10296 | TACTGTTACCGATGCT | kk-d9-eeekk | 71 | 3117 |
| 1014806 | N/A | N/A | 11016 | 11031 | GTGTCTAAAGTCCCAT | kk-d9-eeekk | 77 | 3275 |
| 1014807 | N/A | N/A | 11017 | 11032 | AGTGTCTAAAGTCCCA | kk-d9-eeekk | 74 | 2996 |
| 1014808 | N/A | N/A | 11018 | 11033 | AAGTGTCTAAAGTCCC | kk-d9-eeekk | 79 | 3276 |
| 1014809 | N/A | N/A | 11019 | 11034 | CAAGTGTCTAAAGTCC | kk-d9-eeekk | 78 | 3058 |
| 1014813 | N/A | N/A | 11119 | 11134 | AGCAGTGATGTCAGGT | kk-d9-eeekk | 31 | 2718 |
| 1014814 | N/A | N/A | 11120 | 11135 | AAGCAGTGATGTCAGG | kk-d9-eeekk | 38 | 3277 |
| 1014815 | N/A | N/A | 11121 | 11136 | CAAGCAGTGATGTCAG | kk-d9-eeekk | 85 | 3278 |
| 1014820 | N/A | N/A | 11395 | 11410 | CACATCAATGTTTTAG | kk-d9-eeekk | 88 | 3279 |
| 1014821 | N/A | N/A | 11396 | 11411 | GCACATCAATGTTTTA | kk-d9-eeekk | 80 | 1159 |
| 1014822 | N/A | N/A | 11397 | 11412 | GGCACATCAATGTTTT | kk-d9-eeekk | 78 | 3280 |
| 1014823 | N/A | N/A | 11398 | 11413 | AGGCACATCAATGTTT | kk-d9-eeekk | 64 | 1233 |
| 1014834 | N/A | N/A | 11411 | 11426 | GTGTATTACTCTTAGG | kk-d9-eeekk | 12 | 1540 |

TABLE 56

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 14 | 195 |
| 881450 | 3252 | 3267 | 21369 | 21384 | ACACTTTTAGAGAGGA | kkk-d10-kkk | 24 | 2111 |
| 881659 | 4592 | 4607 | 22709 | 22724 | GGAAGTTTACACTGGA | kkk-d10-kkk | 2 | 2044 |
| 1014835 | N/A | N/A | 11412 | 11427 | TGTGTATTACTCTTAG | kk-d9-eeekk | 59 | 3246 |
| 1014836 | N/A | N/A | 11413 | 11428 | ATGTGTATTACTCTTA | kk-d9-eeekk | 60 | 3281 |
| 1014837 | N/A | N/A | 11414 | 11429 | AATGTGTATTACTCTT | kk-d9-eeekk | 85 | 3282 |
| 1014850 | N/A | N/A | 11565 | 11580 | TGTGCTTGCCAAGCCT | kk-d9-eeekk | 55 | 3283 |
| 1014851 | N/A | N/A | 11566 | 11581 | GTGTGCTTGCCAAGCC | kk-d9-eeekk | 25 | 3000 |
| 1014852 | N/A | N/A | 11567 | 11582 | CGTGTGCTTGCCAAGC | kk-d9-eeekk | 40 | 3284 |
| 1014853 | N/A | N/A | 11568 | 11583 | ACGTGTGCTTGCCAAG | kk-d9-eeekk | 56 | 3285 |
| 1014885 | N/A | N/A | 12514 | 12529 | TTCATGTAAAGTCTGC | kk-d9-eeekk | 73 | 3286 |
| 1014886 | N/A | N/A | 12515 | 12530 | GTTCATGTAAAGTCTG | kk-d9-eeekk | 71 | 934 |
| 1014887 | N/A | N/A | 12516 | 12531 | AGTTCATGTAAAGTCT | kk-d9-eeekk | 59 | 755 |

TABLE 56-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 1014888 | N/A | N/A | 12517 | 12532 | AAGTTCATGTAAAGTC | kk-d9-eeekk | 79 | 3287 |
| 1015224 | N/A | N/A | 10142 | 10157 | ATGTTAGCCAATTCCT | kk-d9-ekeke | 73 | 3272 |
| 1015225 | N/A | N/A | 10143 | 10158 | TATGTTAGCCAATTCC | kk-d9-ekeke | 98 | 2991 |
| 1015226 | N/A | N/A | 10144 | 10159 | TTATGTTAGCCAATTC | kk-d9-ekeke | 91 | 3273 |
| 1015227 | N/A | N/A | 10145 | 10160 | TTTATGTTAGCCAATT | kk-d9-ekeke | 88 | 3274 |
| 1015233 | N/A | N/A | 10278 | 10293 | TGTTACCGATGCTTCA | kk-d9-ekeke | 65 | 2294 |
| 1015234 | N/A | N/A | 10279 | 10294 | CTGTTACCGATGCTTC | kk-d9-ekeke | 50 | 2993 |
| 1015235 | N/A | N/A | 10280 | 10295 | ACTGTTACCGATGCTT | kk-d9-ekeke | 77 | 3055 |
| 1015236 | N/A | N/A | 10281 | 10296 | TACTGTTACCGATGCT | kk-d9-ekeke | 78 | 3117 |
| 1015247 | N/A | N/A | 11016 | 11031 | GTGTCTAAAGTCCCAT | kk-d9-ekeke | 68 | 3275 |
| 1015248 | N/A | N/A | 11017 | 11032 | AGTGTCTAAAGTCCCA | kk-d9-ekeke | 82 | 2996 |
| 1015249 | N/A | N/A | 11018 | 11033 | AAGTGTCTAAAGTCCC | kk-d9-ekeke | 87 | 3276 |
| 1015250 | N/A | N/A | 11019 | 11034 | CAAGTGTCTAAAGTCC | kk-d9-ekeke | 77 | 3058 |
| 1015254 | N/A | N/A | 11119 | 11134 | AGCAGTGATGTCAGGT | kk-d9-ekeke | 28 | 2718 |
| 1015255 | N/A | N/A | 11120 | 11135 | AAGCAGTGATGTCAGG | kk-d9-ekeke | 35 | 3277 |
| 1015256 | N/A | N/A | 11121 | 11136 | CAAGCAGTGATGTCAG | kk-d9-ekeke | 74 | 3278 |
| 1015261 | N/A | N/A | 11395 | 11410 | CACATCAATGTTTTAG | kk-d9-ekeke | 72 | 3279 |
| 1015262 | N/A | N/A | 11396 | 11411 | GCACATCAATGTTTTA | kk-d9-ekeke | 90 | 1159 |
| 1015263 | N/A | N/A | 11397 | 11412 | GGCACATCAATGTTTT | kk-d9-ekeke | 78 | 3280 |
| 1015264 | N/A | N/A | 11398 | 11413 | AGGCACATCAATGTTT | kk-d9-ekeke | 58 | 1233 |
| 1015275 | N/A | N/A | 11411 | 11426 | GTGTATTACTCTTAGG | kk-d9-ekeke | 11 | 1540 |
| 1015276 | N/A | N/A | 11412 | 11427 | TGTGTATTACTCTTAG | kk-d9-ekeke | 46 | 3246 |
| 1015277 | N/A | N/A | 11413 | 11428 | ATGTGTATTACTCTTA | kk-d9-ekeke | 40 | 3281 |
| 1015278 | N/A | N/A | 11414 | 11429 | AATGTGTATTACTCTT | kk-d9-ekeke | 76 | 3282 |
| 1015291 | N/A | N/A | 11565 | 11580 | TGTGCTTGCCAAGCCT | kk-d9-ekeke | 79 | 3283 |
| 1015292 | N/A | N/A | 11566 | 11581 | GTGTGCTTGCCAAGCC | kk-d9-ekeke | 83 | 3000 |
| 1015293 | N/A | N/A | 11567 | 11582 | CGTGTGCTTGCCAAGC | kk-d9-ekeke | 53 | 3284 |
| 1015294 | N/A | N/A | 11568 | 11583 | ACGTGTGCTTGCCAAG | kk-d9-ekeke | 41 | 3285 |
| 1015326 | N/A | N/A | 12514 | 12529 | TTCATGTAAAGTCTGC | kk-d9-ekeke | 68 | 3286 |
| 1015327 | N/A | N/A | 12515 | 12530 | GTTCATGTAAAGTCTG | kk-d9-ekeke | 64 | 934 |
| 1015328 | N/A | N/A | 12516 | 12531 | AGTTCATGTAAAGTCT | kk-d9-ekeke | 49 | 755 |
| 1015329 | N/A | N/A | 12517 | 12532 | AAGTTCATGTAAAGTC | kk-d9-ekeke | 66 | 3287 |

TABLE 57

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 18 | 195 |
| 881450 | 3252 | 3267 | 21369 | 21384 | ACACTTTTAGAGAGGA | kkk-d10-kkk | 28 | 2111 |
| 881659 | 4592 | 4607 | 22709 | 22724 | GGAAGTTTACACTGGA | kkk-d10-kkk | 4 | 2044 |
| 1012810 | N/A | N/A | 10142 | 10157 | ATGTTAGCCAATTCCT | kkk-d10-kkk | 70 | 3272 |
| 1012811 | N/A | N/A | 10144 | 10159 | TTATGTTAGCCAATTC | kkk-d10-kkk | 91 | 3273 |
| 1012812 | N/A | N/A | 10145 | 10160 | TTTATGTTAGCCAATT | kkk-d10-kkk | 75 | 3274 |
| 1012816 | N/A | N/A | 11016 | 11031 | GTGTCTAAAGTCCCAT | kkk-d10-kkk | 82 | 3275 |
| 1012817 | N/A | N/A | 11018 | 11033 | AAGTGTCTAAAGTCCC | kkk-d10-kkk | 50 | 3276 |
| 1012819 | N/A | N/A | 11120 | 11135 | AAGCAGTGATGTCAGG | kkk-d10-kkk | 34 | 3277 |
| 1012820 | N/A | N/A | 11121 | 11136 | CAAGCAGTGATGTCAG | kkk-d10-kkk | 40 | 3278 |
| 1012821 | N/A | N/A | 11395 | 11410 | CACATCAATGTTTTAG | kkk-d10-kkk | 34 | 3279 |
| 1012822 | N/A | N/A | 11397 | 11412 | GGCACATCAATGTTTT | kkk-d10-kkk | 82 | 3280 |
| 1012826 | N/A | N/A | 11413 | 11428 | ATGTGTATTACTCTTA | kkk-d10-kkk | 48 | 3281 |
| 1012827 | N/A | N/A | 11414 | 11429 | AATGTGTATTACTCTT | kkk-d10-kkk | 47 | 3282 |
| 1012835 | N/A | N/A | 11565 | 11580 | TGTGCTTGCCAAGCCT | kkk-d10-kkk | 62 | 3283 |
| 1012836 | N/A | N/A | 11567 | 11582 | CGTGTGCTTGCCAAGC | kkk-d10-kkk | 33 | 3284 |
| 1012837 | N/A | N/A | 11568 | 11583 | ACGTGTGCTTGCCAAG | kkk-d10-kkk | 46 | 3285 |
| 1012845 | N/A | N/A | 12514 | 12529 | TTCATGTAAAGTCTGC | kkk-d10-kkk | 43 | 3286 |
| 1012846 | N/A | N/A | 12517 | 12532 | AAGTTCATGTAAAGTC | kkk-d10-kkk | 57 | 3287 |
| 1015665 | N/A | N/A | 10142 | 10157 | ATGTTAGCCAATTCCT | k-d9-kekeke | 100 | 3272 |
| 1015666 | N/A | N/A | 10143 | 10158 | TATGTTAGCCAATTCC | k-d9-kekeke | 90 | 2991 |
| 1015667 | N/A | N/A | 10144 | 10159 | TTATGTTAGCCAATTC | k-d9-kekeke | 91 | 3273 |
| 1015668 | N/A | N/A | 10145 | 10160 | TTTATGTTAGCCAATT | k-d9-kekeke | 95 | 3274 |
| 1015674 | N/A | N/A | 10278 | 10293 | TGTTACCGATGCTTCA | k-d9-kekeke | 90 | 2294 |
| 1015675 | N/A | N/A | 10279 | 10294 | CTGTTACCGATGCTTC | k-d9-kekeke | 98 | 2993 |
| 1015676 | N/A | N/A | 10280 | 10295 | ACTGTTACCGATGCTT | k-d9-kekeke | 102 | 3055 |
| 1015677 | N/A | N/A | 10281 | 10296 | TACTGTTACCGATGCT | k-d9-kekeke | 82 | 3117 |
| 1015688 | N/A | N/A | 11016 | 11031 | GTGTCTAAAGTCCCAT | k-d9-kekeke | 95 | 3275 |
| 1015689 | N/A | N/A | 11017 | 11032 | AGTGTCTAAAGTCCCA | k-d9-kekeke | 112 | 2996 |
| 1015690 | N/A | N/A | 11018 | 11033 | AAGTGTCTAAAGTCCC | k-d9-kekeke | 96 | 3276 |
| 1015691 | N/A | N/A | 11019 | 11034 | CAAGTGTCTAAAGTCC | k-d9-kekeke | 89 | 3058 |
| 1015695 | N/A | N/A | 11119 | 11134 | AGCAGTGATGTCAGGT | k-d9-kekeke | 74 | 2718 |
| 1015696 | N/A | N/A | 11120 | 11135 | AAGCAGTGATGTCAGG | k-d9-kekeke | 66 | 3277 |
| 1015697 | N/A | N/A | 11121 | 11136 | CAAGCAGTGATGTCAG | k-d9-kekeke | 90 | 3278 |
| 1015702 | N/A | N/A | 11395 | 11410 | CACATCAATGTTTTAG | k-d9-kekeke | 102 | 3279 |
| 1015703 | N/A | N/A | 11396 | 11411 | GCACATCAATGTTTTA | k-d9-kekeke | 83 | 1159 |
| 1015704 | N/A | N/A | 11397 | 11412 | GGCACATCAATGTTTT | k-d9-kekeke | 91 | 3280 |

TABLE 57-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 1015705 | N/A | N/A | 11398 | 11413 | AGGCACATCAATGTTT | k-d9-kekeke | 109 | 1233 |
| 1015716 | N/A | N/A | 11411 | 11426 | GTGTATTACTCTTAGG | k-d9-kekeke | 16 | 1540 |
| 1015717 | N/A | N/A | 11412 | 11427 | TGTGTATTACTCTTAG | k-d9-kekeke | 68 | 3246 |
| 1015718 | N/A | N/A | 11413 | 11428 | ATGTGTATTACTCTTA | k-d9-kekeke | 64 | 3281 |
| 1015719 | N/A | N/A | 11414 | 11429 | AATGTGTATTACTCTT | k-d9-kekeke | 88 | 3282 |
| 1015732 | N/A | N/A | 11565 | 11580 | TGTGCTTGCCAAGCCT | k-d9-kekeke | 103 | 3283 |
| 1015733 | N/A | N/A | 11566 | 11581 | GTGTGCTTGCCAAGCC | k-d9-kekeke | 94 | 3000 |
| 1015734 | N/A | N/A | 11567 | 11582 | CGTGTGCTTGCCAAGC | k-d9-kekeke | 76 | 3284 |
| 1015735 | N/A | N/A | 11568 | 11583 | ACGTGTGCTTGCCAAG | k-d9-kekeke | 60 | 3285 |
| 1015767 | N/A | N/A | 12514 | 12529 | TTCATGTAAAGTCTGC | k-d9-kekeke | 91 | 3286 |
| 1015768 | N/A | N/A | 12515 | 12530 | GTTCATGTAAAGTCTG | k-d9-kekeke | 76 | 934 |
| 1015769 | N/A | N/A | 12516 | 12531 | AGTTCATGTAAAGTCT | k-d9-kekeke | 71 | 755 |
| 1015770 | N/A | N/A | 12517 | 12532 | AAGTTCATGTAAAGTC | k-d9-kekeke | 86 | 3287 |

TABLE 58

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 11 | 195 |
| 881450 | 3252 | 3267 | 21369 | 21384 | ACACTTTTAGAGAGGA | kkk-d10-kkk | 29 | 2111 |
| 881659 | 4592 | 4607 | 22709 | 22724 | GGAAGTTTACACTGGA | kkk-d10-kkk | 4 | 2044 |
| 935595 | 3075 | 3090 | 21192 | 21207 | ACTAAGCTTGATAAAG | kkk-d10-kkk | 86 | 3288 |
| 935607 | 4195 | 4210 | 22312 | 22327 | AGTGTTCCAGGAGATA | kkk-d10-kkk | 20 | 3289 |
| 1012769 | N/A | N/A | 4810 | 4825 | GCTCCCGACACGCGCC | kkk-d10-kkk | 97 | 3290 |
| 1012772 | N/A | N/A | 6267 | 6282 | ATGCGGAGGTTCCTTG | kkk-d10-kkk | 53 | 3291 |
| 1012774 | N/A | N/A | 6271 | 6286 | TGAGATGCGGAGGTTC | kkk-d10-kkk | 67 | 3292 |
| 1012775 | N/A | N/A | 6273 | 6288 | AGTGAGATGCGGAGGT | kkk-d10-kkk | 35 | 3293 |
| 1012776 | N/A | N/A | 6275 | 6290 | AGAGTGAGATGCGGAG | kkk-d10-kkk | 35 | 3294 |
| 1012778 | N/A | N/A | 6281 | 6296 | ACCGGTAGAGTGAGAT | kkk-d10-kkk | 84 | 3295 |
| 1012782 | N/A | N/A | 7634 | 7649 | GAGTTGTACAGGACAG | kkk-d10-kkk | 49 | 3296 |
| 1012785 | N/A | N/A | 7638 | 7653 | GTCTGAGTTGTACAGG | kkk-d10-kkk | 48 | 3297 |
| 1012786 | N/A | N/A | 7640 | 7655 | AGGTCTGAGTTGTACA | kkk-d10-kkk | 45 | 3298 |
| 1012788 | N/A | N/A | 8386 | 8401 | AATGGAGATACTTGTA | kkk-d10-kkk | 74 | 3299 |
| 1012790 | N/A | N/A | 8389 | 8404 | GACAATGGAGATACTT | kkk-d10-kkk | 67 | 3300 |
| 1012791 | 678 | 693 | 9168 | 9183 | TTCCGGGTGTGGCTGA | kkk-d10-kkk | 75 | 3301 |

TABLE 58-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 1012793 | 680 | 695 | 9170 | 9185 | ATTTCCGGGTGTGGCT | kkk-d10-kkk | 93 | 3302 |
| 1012795 | N/A | N/A | 9667 | 9682 | GTATTTTTCCGTTCCT | kkk-d10-kkk | 16 | 3303 |
| 1012796 | N/A | N/A | 9670 | 9685 | ATGGTATTTTCCGTT | kkk-d10-kkk | 68 | 3304 |
| 1012799 | N/A | N/A | 9677 | 9692 | GTTTGCCATGGTATTT | kkk-d10-kkk | 59 | 3305 |
| 1012804 | N/A | N/A | 9840 | 9855 | CATTGCTAGATTCTCC | kkk-d10-kkk | 82 | 3306 |
| 1012806 | N/A | N/A | 9846 | 9861 | TTACCGCATTGCTAGA | kkk-d10-kkk | 87 | 3307 |
| 1012808 | N/A | N/A | 9851 | 9866 | CTGAGTTACCGCATTG | kkk-d10-kkk | 51 | 3308 |
| 1012809 | N/A | N/A | 10139 | 10154 | TTAGCCAATTCCTCCA | kkk-d10-kkk | 64 | 3309 |
| 1012813 | N/A | N/A | 10274 | 10289 | ACCGATGCTTCAAGAC | kkk-d10-kkk | 69 | 3310 |
| 1012814 | N/A | N/A | 10276 | 10291 | TTACCGATGCTTCAAG | kkk-d10-kkk | 84 | 3311 |
| 1012815 | N/A | N/A | 10282 | 10297 | TTACTGTTACCGATGC | kkk-d10-kkk | 74 | 3312 |
| 1012818 | N/A | N/A | 11020 | 11035 | GCAAGTGTCTAAAGTC | kkk-d10-kkk | 51 | 3313 |
| 1012823 | N/A | N/A | 11400 | 11415 | TTAGGCACATCAATGT | kkk-d10-kkk | 88 | 3314 |
| 1012825 | N/A | N/A | 11406 | 11421 | TTACTCTTAGGCACAT | kkk-d10-kkk | 56 | 3315 |
| 1012828 | N/A | N/A | 11523 | 11538 | GATCTCCATGGTGCAG | kkk-d10-kkk | 78 | 3316 |
| 1012831 | N/A | N/A | 11530 | 11545 | TAGGTAAGATCTCCAT | kkk-d10-kkk | 65 | 3317 |
| 1012834 | N/A | N/A | 11564 | 11579 | GTGCTTGCCAAGCCTA | kkk-d10-kkk | 73 | 3318 |
| 1012840 | N/A | N/A | 11659 | 11674 | CCAAACCTTAAGCTAT | kkk-d10-kkk | 82 | 3319 |
| 1012841 | N/A | N/A | 11663 | 11678 | AATTCCAAACCTTAAG | kkk-d10-kkk | 102 | 3320 |
| 1012843 | N/A | N/A | 11995 | 12010 | AGGTTGCCGAGATATA | kkk-d10-kkk | 46 | 3321 |
| 1012844 | N/A | N/A | 11997 | 12012 | CGAGGTTGCCGAGATA | kkk-d10-kkk | 34 | 3322 |
| 1012848 | N/A | N/A | 14251 | 14266 | GAGCCAACTTATAGCA | kkk-d10-kkk | 89 | 3323 |
| 1012850 | N/A | N/A | 14253 | 14268 | CAGAGCCAACTTATAG | kkk-d10-kkk | 70 | 3324 |
| 1012852 | N/A | N/A | 14734 | 14749 | GAAGCTTAGTTATCTG | kkk-d10-kkk | 55 | 3325 |
| 1012855 | N/A | N/A | 14739 | 14754 | GGCCTGAAGCTTAGTT | kkk-d10-kkk | 105 | 3326 |
| 1012859 | N/A | N/A | 15594 | 15609 | GTCGCGCAAGTCTACA | kkk-d10-kkk | 96 | 3327 |
| 1012860 | N/A | N/A | 15841 | 15856 | GTTGGCACAATTCTCT | kkk-d10-kkk | 78 | 3328 |
| 1012864 | N/A | N/A | 15845 | 15860 | GCGAGTTGGCACAATT | kkk-d10-kkk | 73 | 3329 |
| 1012866 | N/A | N/A | 15848 | 15863 | ATGGCGAGTTGGCACA | kkk-d10-kkk | 51 | 3330 |
| 1012867 | N/A | N/A | 15850 | 15865 | GAATGGCGAGTTGGCA | kkk-d10-kkk | 61 | 3331 |
| 1012869 | N/A | N/A | 15884 | 15899 | CGTGATCTGAGACTAC | kkk-d10-kkk | 75 | 3332 |
| 1012872 | N/A | N/A | 15889 | 15904 | ACTGCCGTGATCTGAG | kkk-d10-kkk | 66 | 3333 |
| 1012920 | 1441 | 1456 | 19558 | 19573 | TAGATCTGTGGTAATC | kkk-d10-kkk | 80 | 3334 |
| 1012921 | 1450 | 1465 | 19567 | 19582 | AATGGCGGATAGATCT | kkk-d10-kkk | 90 | 3335 |

Example 11: Effect of Mixed MOE and cEt Gapmers with Phosphorothioate Internucleoside Linkages on Human IRF4 In Vitro, Single Dose Modified oligonucleotides complementary to a human IRF4 nucleic acid were designed and tested for their effect on IRF4 mRNA in vitro.

Cultured MM.1R cells at a density of 5,000 cells per well were transfected by free uptake with 1,000 nM concentration of modified oligonucleotide or no modified oligonucleotide for untreated controls. After approximately 24 hours, RNA was isolated from the cells and IRF4 mRNA levels were measured by quantitative real-time PCR. Human primer probe set RTS4522 (forward sequence CGGAAATCCCGTACCAATGT, designated herein as SEQ ID NO: 3392; reverse sequence TGGCAACCATTTT-CACAAGCT designated herein as SEQ ID NO: 3393; probe sequence TTTGGACCCCGCGGCCAC, designated herein as SEQ ID: 3394) was used to measure mRNA levels. IRF4 mRNA levels were adjusted according to total RNA content, as measured by RIBOGREEN®. Results are presented in the tables below as percent control of the amount of IRF4 mRNA, relative to untreated control (UTC) cells.

The modified oligonucleotides in Tables 59 through 64 are cEt and/or MOE containing gapmers. The modified oligonucleotides have a central gap segment comprising 2'-deoxynucleosides which is flanked by wing segments on the 5' direction and the 3' direction. At least one nucleoside in the 5' wing segment and/or one nucleoside in the 3' wing segment has a MOE and/or cEt sugar modification. The "Motif" column describes the sugar modifications of each oligonucleotide. "k" indicates a cEt sugar modification; "d" indicates deoxyribose; and "e" indicates a MOE modification. Each internucleoside linkage is a phosphorothioate internucleoside linkage and each cytosine residue is a 5-methylcytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Table 59 through 64 below is complementary to human IRF4 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to human IRF4 reduced the amount of human IRF4 mRNA.

TABLE 59

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 24 | 195 |
| 881450 | 3252 | 3267 | 21369 | 21384 | ACACTTTTAGAGAGGA | kkk-d10-kkk | 29 | 2111 |
| 881659 | 4592 | 4607 | 22709 | 22724 | GGAAGTTTACACTGGA | kkk-d10-kkk | 14 | 2044 |
| 1013023 | N/A | N/A | 10142 | 10157 | ATGTTAGCCAATTCCT | k-d10-kekek | 93 | 3272 |
| 1013024 | N/A | N/A | 10143 | 10158 | TATGTTAGCCAATTCC | k-d10-kekek | 99 | 2991 |
| 1013025 | N/A | N/A | 10144 | 10159 | TTATGTTAGCCAATTC | k-d10-kekek | 94 | 3273 |
| 1013026 | N/A | N/A | 10145 | 10160 | TTTATGTTAGCCAATT | k-d10-kekek | 112 | 3274 |
| 1013032 | N/A | N/A | 10278 | 10293 | TGTTACCGATGCTTCA | k-d10-kekek | 82 | 2294 |
| 1013033 | N/A | N/A | 10279 | 10294 | CTGTTACCGATGCTTC | k-d10-kekek | 74 | 2993 |
| 1013034 | N/A | N/A | 10280 | 10295 | ACTGTTACCGATGCTT | k-d10-kekek | 80 | 3055 |
| 1013035 | N/A | N/A | 10281 | 10296 | TACTGTTACCGATGCT | k-d10-kekek | 98 | 3117 |
| 1013046 | N/A | N/A | 11016 | 11031 | GTGTCTAAAGTCCCAT | k-d10-kekek | 77 | 3275 |
| 1013047 | N/A | N/A | 11017 | 11032 | AGTGTCTAAAGTCCCA | k-d10-kekek | 97 | 2996 |
| 1013048 | N/A | N/A | 11018 | 11033 | AAGTGTCTAAAGTCCC | k-d10-kekek | 101 | 3276 |
| 1013049 | N/A | N/A | 11019 | 11034 | CAAGTGTCTAAAGTCC | k-d10-kekek | 88 | 3058 |
| 1013053 | N/A | N/A | 11119 | 11134 | AGCAGTGATGTCAGGT | k-d10-kekek | 33 | 2718 |
| 1013054 | N/A | N/A | 11120 | 11135 | AAGCAGTGATGTCAGG | k-d10-kekek | 61 | 3277 |
| 1013055 | N/A | N/A | 11121 | 11136 | CAAGCAGTGATGTCAG | k-d10-kekek | 57 | 3278 |
| 1013060 | N/A | N/A | 11395 | 11410 | CACATCAATGTTTTAG | k-d10-kekek | 81 | 3279 |
| 1013061 | N/A | N/A | 11396 | 11411 | GCACATCAATGTTTTA | k-d10-kekek | 100 | 1159 |
| 1013062 | N/A | N/A | 11397 | 11412 | GGCACATCAATGTTTT | k-d10-kekek | 75 | 3280 |

TABLE 59-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 1013063 | N/A | N/A | 11398 | 11413 | AGGCACATCAATGTTT | k-d10-kekek | 95 | 1233 |
| 1013074 | N/A | N/A | 11411 | 11426 | GTGTATTACTCTTAGG | k-d10-kekek | 20 | 1540 |
| 1013075 | N/A | N/A | 11412 | 11427 | TGTGTATTACTCTTAG | k-d10-kekek | 44 | 3246 |
| 1013076 | N/A | N/A | 11413 | 11428 | ATGTGTATTACTCTTA | k-d10-kekek | 96 | 3281 |
| 1013077 | N/A | N/A | 11414 | 11429 | AATGTGTATTACTCTT | k-d10-kekek | 71 | 3282 |
| 1013090 | N/A | N/A | 11565 | 11580 | TGTGCTTGCCAAGCCT | k-d10-kekek | 97 | 3283 |
| 1013091 | N/A | N/A | 11566 | 11581 | GTGTGCTTGCCAAGCC | k-d10-kekek | 77 | 3000 |
| 1013092 | N/A | N/A | 11567 | 11582 | CGTGTGCTTGCCAAGC | k-d10-kekek | 68 | 3284 |
| 1013093 | N/A | N/A | 11568 | 11583 | ACGTGTGCTTGCCAAG | k-d10-kekek | 63 | 3285 |
| 1013125 | N/A | N/A | 12514 | 12529 | TTCATGTAAAGTCTGC | k-d10-kekek | 118 | 3286 |
| 1013126 | N/A | N/A | 12515 | 12530 | GTTCATGTAAAGTCTG | k-d10-kekek | 78 | 934 |
| 1013127 | N/A | N/A | 12516 | 12531 | AGTTCATGTAAAGTCT | k-d10-kekek | 78 | 755 |
| 1013128 | N/A | N/A | 12517 | 12532 | AAGTTCATGTAAAGTC | k-d10-kekek | 94 | 3287 |
| 1013207 | N/A | N/A | 18073 | 18088 | GTTGGCTGGTCTTTGT | k-d10-kekek | 77 | 3336 |
| 1013208 | N/A | N/A | 18074 | 18089 | GGTTGGCTGGTCTTTG | k-d10-kekek | 53 | 3337 |
| 1013209 | N/A | N/A | 18075 | 18090 | TGGTTGGCTGGTCTTT | k-d10-kekek | 91 | 3338 |
| 1013210 | N/A | N/A | 18076 | 18091 | TTGGTTGGCTGGTCTT | k-d10-kekek | 66 | 3339 |
| 1013213 | N/A | N/A | 18087 | 18102 | TTATATACTGGTTGGT | k-d10-kekek | 78 | 1179 |
| 1013214 | N/A | N/A | 18088 | 18103 | ATTATATACTGGTTGG | k-d10-kekek | 78 | 3340 |
| 1013215 | N/A | N/A | 18089 | 18104 | GATTATATACTGGTTG | k-d10-kekek | 52 | 1254 |
| 1013216 | N/A | N/A | 18090 | 18105 | GGATTATATACTGGTT | k-d10-kekek | 65 | 1330 |
| 1013217 | N/A | N/A | 18091 | 18106 | GGGATTATATACTGGT | k-d10-kekek | 66 | 3341 |
| 1013218 | N/A | N/A | 18092 | 18107 | TGGGATTATATACTGG | k-d10-kekek | 57 | 3342 |
| 1013232 | N/A | N/A | 18571 | 18586 | TGATAGCTGAGCTGAT | k-d10-kekek | 78 | 2546 |
| 1013233 | N/A | N/A | 18572 | 18587 | GTGATAGCTGAGCTGA | k-d10-kekek | 71 | 3343 |
| 1013234 | N/A | N/A | 18573 | 18588 | TGTGATAGCTGAGCTG | k-d10-kekek | 102 | 3344 |
| 1013235 | N/A | N/A | 18574 | 18589 | ATGTGATAGCTGAGCT | k-d10-kekek | 103 | 3345 |
| 1013236 | N/A | N/A | 18575 | 18590 | GATGTGATAGCTGAGC | k-d10-kekek | 50 | 3346 |
| 1013237 | N/A | N/A | 18576 | 18591 | TGATGTGATAGCTGAG | k-d10-kekek | 82 | 3347 |
| 1013238 | N/A | N/A | 18577 | 18592 | TTGATGTGATAGCTGA | k-d10-kekek | 88 | 3348 |
| 1013252 | N/A | N/A | 18611 | 18626 | AGTGACTTGCATCCAT | k-d10-kekek | 98 | 3349 |
| 1013253 | N/A | N/A | 18612 | 18627 | CAGTGACTTGCATCCA | k-d10-kekek | 71 | 3350 |
| 1013254 | N/A | N/A | 18613 | 18628 | ACAGTGACTTGCATCC | k-d10-kekek | 105 | 3351 |
| 1013255 | N/A | N/A | 18614 | 18629 | GACAGTGACTTGCATC | k-d10-kekek | 92 | 3352 |
| 1013462 | N/A | N/A | 10142 | 10157 | ATGTTAGCCAATTCCT | kk-d9-kekek | 56 | 3272 |
| 1013463 | N/A | N/A | 10143 | 10158 | TATGTTAGCCAATTCC | kk-d9-kekek | 97 | 2991 |
| 1013464 | N/A | N/A | 10144 | 10159 | TTATGTTAGCCAATTC | kk-d9-kekek | 81 | 3273 |

TABLE 59-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 1013465 | N/A | N/A | 10145 | 10160 | TTTATGTTAGCCAATT | kk-d9-kekek | 85 | 3274 |
| 1013471 | N/A | N/A | 10278 | 10293 | TGTTACCGATGCTTCA | kk-d9-kekek | 79 | 2294 |
| 1013472 | N/A | N/A | 10279 | 10294 | CTGTTACCGATGCTTC | kk-d9-kekek | 56 | 2993 |
| 1013473 | N/A | N/A | 10280 | 10295 | ACTGTTACCGATGCTT | kk-d9-kekek | 82 | 3055 |
| 1013474 | N/A | N/A | 10281 | 10296 | TACTGTTACCGATGCT | kk-d9-kekek | 73 | 3117 |
| 1013485 | N/A | N/A | 11016 | 11031 | GTGTCTAAAGTCCCAT | kk-d9-kekek | 61 | 3275 |
| 1013486 | N/A | N/A | 11017 | 11032 | AGTGTCTAAAGTCCCA | kk-d9-kekek | 91 | 2996 |
| 1013487 | N/A | N/A | 11018 | 11033 | AAGTGTCTAAAGTCCC | kk-d9-kekek | 78 | 3276 |
| 1013488 | N/A | N/A | 11019 | 11034 | CAAGTGTCTAAAGTCC | kk-d9-kekek | 94 | 3058 |
| 1013492 | N/A | N/A | 11119 | 11134 | AGCAGTGATGTCAGGT | kk-d9-kekek | 33 | 2718 |
| 1013493 | N/A | N/A | 11120 | 11135 | AAGCAGTGATGTCAGG | kk-d9-kekek | 56 | 3277 |
| 1013494 | N/A | N/A | 11121 | 11136 | CAAGCAGTGATGTCAG | kk-d9-kekek | 48 | 3278 |
| 1013499 | N/A | N/A | 11395 | 11410 | CACATCAATGTTTTAG | kk-d9-kekek | 66 | 3279 |
| 1013500 | N/A | N/A | 11396 | 11411 | GCACATCAATGTTTTA | kk-d9-kekek | 85 | 1159 |
| 1013501 | N/A | N/A | 11397 | 11412 | GGCACATCAATGTTTT | kk-d9-kekek | 81 | 3280 |
| 1013502 | N/A | N/A | 11398 | 11413 | AGGCACATCAATGTTT | kk-d9-kekek | 81 | 1233 |
| 1013513 | N/A | N/A | 11411 | 11426 | GTGTATTACTCTTAGG | kk-d9-kekek | 22 | 1540 |
| 1013514 | N/A | N/A | 11412 | 11427 | TGTGTATTACTCTTAG | kk-d9-kekek | 21 | 3246 |
| 1013515 | N/A | N/A | 11413 | 11428 | ATGTGTATTACTCTTA | kk-d9-kekek | 51 | 3281 |
| 1013516 | N/A | N/A | 11414 | 11429 | AATGTGTATTACTCTT | kk-d9-kekek | 59 | 3282 |
| 1013529 | N/A | N/A | 11565 | 11580 | TGTGCTTGCCAAGCCT | kk-d9-kekek | 82 | 3283 |

TABLE 60

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 18 | 195 |
| 881450 | 3252 | 3267 | 21369 | 21384 | ACACTTTTAGAGAGGA | kkk-d10-kkk | 36 | 2111 |
| 881659 | 4592 | 4607 | 22709 | 22724 | GGAAGTTTACACTGGA | kkk-d10-kkk | 10 | 2044 |
| 1013530 | N/A | N/A | 11566 | 11581 | GTGTGCTTGCCAAGCC | kk-d9-kekek | 61 | 3000 |
| 1013531 | N/A | N/A | 11567 | 11582 | CGTGTGCTTGCCAAGC | kk-d9-kekek | 57 | 3284 |
| 1013532 | N/A | N/A | 11568 | 11583 | ACGTGTGCTTGCCAAG | kk-d9-kekek | 56 | 3285 |
| 1013564 | N/A | N/A | 12514 | 12529 | TTCATGTAAAGTCTGC | kk-d9-kekek | 88 | 3286 |
| 1013565 | N/A | N/A | 12515 | 12530 | GTTCATGTAAAGTCTG | kk-d9-kekek | 66 | 934 |
| 1013566 | N/A | N/A | 12516 | 12531 | AGTTCATGTAAAGTCT | kk-d9-kekek | 69 | 755 |

TABLE 60-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 1013567 | N/A | N/A | 12517 | 12532 | AAGTTCATGTAAAGTC | kk-d9-kekek | 73 | 3287 |
| 1013646 | N/A | N/A | 18073 | 18088 | GTTGGCTGGTCTTTGT | kk-d9-kekek | 38 | 3336 |
| 1013647 | N/A | N/A | 18074 | 18089 | GGTTGGCTGGTCTTTG | kk-d9-kekek | 33 | 3337 |
| 1013648 | N/A | N/A | 18075 | 18090 | TGGTTGGCTGGTCTTT | kk-d9-kekek | 56 | 3338 |
| 1013649 | N/A | N/A | 18076 | 18091 | TTGGTTGGCTGGTCTT | kk-d9-kekek | 35 | 3339 |
| 1013652 | N/A | N/A | 18087 | 18102 | TTATATACTGGTTGGT | kk-d9-kekek | 50 | 1179 |
| 1013653 | N/A | N/A | 18088 | 18103 | ATTATATACTGGTTGG | kk-d9-kekek | 48 | 3340 |
| 1013654 | N/A | N/A | 18089 | 18104 | GATTATATACTGGTTG | kk-d9-kekek | 55 | 1254 |
| 1013655 | N/A | N/A | 18090 | 18105 | GGATTATATACTGGTT | kk-d9-kekek | 35 | 1330 |
| 1013656 | N/A | N/A | 18091 | 18106 | GGGATTATATACTGGT | kk-d9-kekek | 60 | 3341 |
| 1013657 | N/A | N/A | 18092 | 18107 | TGGGATTATATACTGG | kk-d9-kekek | 58 | 3342 |
| 1013672 | N/A | N/A | 18572 | 18587 | GTGATAGCTGAGCTGA | kk-d9-kekek | 61 | 3343 |
| 1013673 | N/A | N/A | 18573 | 18588 | TGTGATAGCTGAGCTG | kk-d9-kekek | 83 | 3344 |
| 1013674 | N/A | N/A | 18574 | 18589 | ATGTGATAGCTGAGCT | kk-d9-kekek | 76 | 3345 |
| 1013675 | N/A | N/A | 18575 | 18590 | GATGTGATAGCTGAGC | kk-d9-kekek | 69 | 3346 |
| 1013676 | N/A | N/A | 18576 | 18591 | TGATGTGATAGCTGAG | kk-d9-kekek | 102 | 3347 |
| 1013677 | N/A | N/A | 18577 | 18592 | TTGATGTGATAGCTGA | kk-d9-kekek | 76 | 3348 |
| 1013691 | N/A | N/A | 18611 | 18626 | AGTGACTTGCATCCAT | kk-d9-kekek | 73 | 3349 |
| 1013692 | N/A | N/A | 18612 | 18627 | CAGTGACTTGCATCCA | kk-d9-kekek | 74 | 3350 |
| 1013693 | N/A | N/A | 18613 | 18628 | ACAGTGACTTGCATCC | kk-d9-kekek | 68 | 3351 |
| 1013694 | N/A | N/A | 18614 | 18629 | GACAGTGACTTGCATC | kk-d9-kekek | 95 | 3352 |
| 1013902 | N/A | N/A | 10142 | 10157 | ATGTTAGCCAATTCCT | kk-d10-keke | 85 | 3272 |
| 1013903 | N/A | N/A | 10143 | 10158 | TATGTTAGCCAATTCC | kk-d10-keke | 75 | 2991 |
| 1013904 | N/A | N/A | 10144 | 10159 | TTATGTTAGCCAATTC | kk-d10-keke | 84 | 3273 |
| 1013905 | N/A | N/A | 10145 | 10160 | TTTATGTTAGCCAATT | kk-d10-keke | 105 | 3274 |
| 1013911 | N/A | N/A | 10278 | 10293 | TGTTACCGATGCTTCA | kk-d10-keke | 58 | 2294 |
| 1013912 | N/A | N/A | 10279 | 10294 | CTGTTACCGATGCTTC | kk-d10-keke | 63 | 2993 |
| 1013913 | N/A | N/A | 10280 | 10295 | ACTGTTACCGATGCTT | kk-d10-keke | 52 | 3055 |
| 1013914 | N/A | N/A | 10281 | 10296 | TACTGTTACCGATGCT | kk-d10-keke | 83 | 3117 |
| 1013925 | N/A | N/A | 11016 | 11031 | GTGTCTAAAGTCCCAT | kk-d10-keke | 94 | 3275 |
| 1013926 | N/A | N/A | 11017 | 11032 | AGTGTCTAAAGTCCCA | kk-d10-keke | 61 | 2996 |
| 1013927 | N/A | N/A | 11018 | 11033 | AAGTGTCTAAAGTCCC | kk-d10-keke | 88 | 3276 |
| 1013928 | N/A | N/A | 11019 | 11034 | CAAGTGTCTAAAGTCC | kk-d10-keke | 83 | 3058 |
| 1013932 | N/A | N/A | 11119 | 11134 | AGCAGTGATGTCAGGT | kk-d10-keke | 36 | 2718 |
| 1013933 | N/A | N/A | 11120 | 11135 | AAGCAGTGATGTCAGG | kk-d10-keke | 24 | 3277 |
| 1013934 | N/A | N/A | 11121 | 11136 | CAAGCAGTGATGTCAG | kk-d10-keke | 74 | 3278 |
| 1013939 | N/A | N/A | 11395 | 11410 | CACATCAATGTTTTAG | kk-d10-keke | 61 | 3279 |

TABLE 60-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 1013940 | N/A | N/A | 11396 | 11411 | GCACATCAATGTTTTA | kk-d10-keke | 50 | 1159 |
| 1013941 | N/A | N/A | 11397 | 11412 | GGCACATCAATGTTTT | kk-d10-keke | 91 | 3280 |
| 1013942 | N/A | N/A | 11398 | 11413 | AGGCACATCAATGTTT | kk-d10-keke | 86 | 1233 |
| 1013953 | N/A | N/A | 11411 | 11426 | GTGTATTACTCTTAGG | kk-d10-keke | 28 | 1540 |
| 1013954 | N/A | N/A | 11412 | 11427 | TGTGTATTACTCTTAG | kk-d10-keke | 61 | 3246 |
| 1013955 | N/A | N/A | 11413 | 11428 | ATGTGTATTACTCTTA | kk-d10-keke | 52 | 3281 |
| 1013956 | N/A | N/A | 11414 | 11429 | AATGTGTATTACTCTT | kk-d10-keke | 78 | 3282 |
| 1013969 | N/A | N/A | 11565 | 11580 | TGTGCTTGCCAAGCCT | kk-d10-keke | 70 | 3283 |
| 1013970 | N/A | N/A | 11566 | 11581 | GTGTGCTTGCCAAGCC | kk-d10-keke | 53 | 3000 |
| 1013971 | N/A | N/A | 11567 | 11582 | CGTGTGCTTGCCAAGC | kk-d10-keke | 55 | 3284 |
| 1013972 | N/A | N/A | 11568 | 11583 | ACGTGTGCTTGCCAAG | kk-d10-keke | 74 | 3285 |
| 1014004 | N/A | N/A | 12514 | 12529 | TTCATGTAAAGTCTGC | kk-d10-keke | 72 | 3286 |
| 1014005 | N/A | N/A | 12515 | 12530 | GTTCATGTAAAGTCTG | kk-d10-keke | 58 | 934 |
| 1014006 | N/A | N/A | 12516 | 12531 | AGTTCATGTAAAGTCT | kk-d10-keke | 51 | 755 |
| 1014007 | N/A | N/A | 12517 | 12532 | AAGTTCATGTAAAGTC | kk-d10-keke | 80 | 3287 |
| 1014086 | N/A | N/A | 18073 | 18088 | GTTGGCTGGTCTTTGT | kk-d10-keke | 75 | 3336 |
| 1014087 | N/A | N/A | 18074 | 18089 | GGTTGGCTGGTCTTTG | kk-d10-keke | 24 | 3337 |
| 1014088 | N/A | N/A | 18075 | 18090 | TGGTTGGCTGGTCTTT | kk-d10-keke | 20 | 3338 |
| 1014089 | N/A | N/A | 18076 | 18091 | TTGGTTGGCTGGTCTT | kk-d10-keke | 73 | 3339 |
| 1014092 | N/A | N/A | 18087 | 18102 | TTATATACTGGTTGGT | kk-d10-keke | 53 | 1179 |
| 1014093 | N/A | N/A | 18088 | 18103 | ATTATATACTGGTTGG | kk-d10-keke | 68 | 3340 |
| 1014094 | N/A | N/A | 18089 | 18104 | GATTATATACTGGTTG | kk-d10-keke | 55 | 1254 |
| 1014095 | N/A | N/A | 18090 | 18105 | GGATTATATACTGGTT | kk-d10-keke | 22 | 1330 |
| 1014096 | N/A | N/A | 18091 | 18106 | GGGATTATATACTGGT | kk-d10-keke | 54 | 3341 |
| 1014097 | N/A | N/A | 18092 | 18107 | TGGGATTATATACTGG | kk-d10-keke | 32 | 3342 |
| 1014111 | N/A | N/A | 18571 | 18586 | TGATAGCTGAGCTGAT | kk-d10-keke | 117 | 2546 |
| 1014112 | N/A | N/A | 18572 | 18587 | GTGATAGCTGAGCTGA | kk-d10-keke | 65 | 3343 |
| 1014113 | N/A | N/A | 18573 | 18588 | TGTGATAGCTGAGCTG | kk-d10-keke | 84 | 3344 |
| 1014114 | N/A | N/A | 18574 | 18589 | ATGTGATAGCTGAGCT | kk-d10-keke | 96 | 3345 |
| 1014115 | N/A | N/A | 18575 | 18590 | GATGTGATAGCTGAGC | kk-d10-keke | 36 | 3346 |
| 1014116 | N/A | N/A | 18576 | 18591 | TGATGTGATAGCTGAG | kk-d10-keke | 46 | 3347 |
| 1014117 | N/A | N/A | 18577 | 18592 | TTGATGTGATAGCTGA | kk-d10-keke | 89 | 3348 |

TABLE 61

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 24 | 195 |
| 881450 | 3252 | 3267 | 21369 | 21384 | ACACTTTTAGAGAGGA | kkk-d10-kkk | 32 | 2111 |
| 881659 | 4592 | 4607 | 22709 | 22724 | GGAAGTTTACACTGGA | kkk-d10-kkk | 11 | 2044 |
| 1014131 | N/A | N/A | 18611 | 18626 | AGTGACTTGCATCCAT | kk-d10-keke | 50 | 3349 |
| 1014132 | N/A | N/A | 18612 | 18627 | CAGTGACTTGCATCCA | kk-d10-keke | 67 | 3350 |
| 1014133 | N/A | N/A | 18613 | 18628 | ACAGTGACTTGCATCC | kk-d10-keke | 70 | 3351 |
| 1014134 | N/A | N/A | 18614 | 18629 | GACAGTGACTTGCATC | kk-d10-keke | 75 | 3352 |
| 1014342 | N/A | N/A | 10142 | 10157 | ATGTTAGCCAATTCCT | kk-d9-kdkdk | 97 | 3272 |
| 1014343 | N/A | N/A | 10143 | 10158 | TATGTTAGCCAATTCC | kk-d9-kdkdk | 66 | 2991 |
| 1014344 | N/A | N/A | 10144 | 10159 | TTATGTTAGCCAATTC | kk-d9-kdkdk | 74 | 3273 |
| 1014345 | N/A | N/A | 10145 | 10160 | TTTATGTTAGCCAATT | kk-d9-kdkdk | 66 | 3274 |
| 1014351 | N/A | N/A | 10278 | 10293 | TGTTACCGATGCTTCA | kk-d9-kdkdk | 74 | 2294 |
| 1014352 | N/A | N/A | 10279 | 10294 | CTGTTACCGATGCTTC | kk-d9-kdkdk | 48 | 2993 |
| 1014353 | N/A | N/A | 10280 | 10295 | ACTGTTACCGATGCTT | kk-d9-kdkdk | 69 | 3055 |
| 1014354 | N/A | N/A | 10281 | 10296 | TACTGTTACCGATGCT | kk-d9-kdkdk | 82 | 3117 |
| 1014365 | N/A | N/A | 11016 | 11031 | GTGTCTAAAGTCCCAT | kk-d9-kdkdk | 95 | 3275 |
| 1014366 | N/A | N/A | 11017 | 11032 | AGTGTCTAAAGTCCCA | kk-d9-kdkdk | 105 | 2996 |
| 1014367 | N/A | N/A | 11018 | 11033 | AAGTGTCTAAAGTCCC | kk-d9-kdkdk | 79 | 3276 |
| 1014368 | N/A | N/A | 11019 | 11034 | CAAGTGTCTAAAGTCC | kk-d9-kdkdk | 71 | 3058 |
| 1014372 | N/A | N/A | 11119 | 11134 | AGCAGTGATGTCAGGT | kk-d9-kdkdk | 52 | 2718 |
| 1014373 | N/A | N/A | 11120 | 11135 | AAGCAGTGATGTCAGG | kk-d9-kdkdk | 39 | 3277 |
| 1014374 | N/A | N/A | 11121 | 11136 | CAAGCAGTGATGTCAG | kk-d9-kdkdk | 51 | 3278 |
| 1014379 | N/A | N/A | 11395 | 11410 | CACATCAATGTTTTAG | kk-d9-kdkdk | 63 | 3279 |
| 1014380 | N/A | N/A | 11396 | 11411 | GCACATCAATGTTTTA | kk-d9-kdkdk | 93 | 1159 |
| 1014381 | N/A | N/A | 11397 | 11412 | GGCACATCAATGTTTT | kk-d9-kdkdk | 84 | 3280 |
| 1014382 | N/A | N/A | 11398 | 11413 | AGGCACATCAATGTTT | kk-d9-kdkdk | 81 | 1233 |
| 1014393 | N/A | N/A | 11411 | 11426 | GTGTATTACTCTTAGG | kk-d9-kdkdk | 17 | 1540 |
| 1014394 | N/A | N/A | 11412 | 11427 | TGTGTATTACTCTTAG | kk-d9-kdkdk | 29 | 3246 |
| 1014395 | N/A | N/A | 11413 | 11428 | ATGTGTATTACTCTTA | kk-d9-kdkdk | 68 | 3281 |
| 1014396 | N/A | N/A | 11414 | 11429 | AATGTGTATTACTCTT | kk-d9-kdkdk | 85 | 3282 |
| 1014409 | N/A | N/A | 11565 | 11580 | TGTGCTTGCCAAGCCT | kk-d9-kdkdk | 79 | 3283 |
| 1014410 | N/A | N/A | 11566 | 11581 | GTGTGCTTGCCAAGCC | kk-d9-kdkdk | 41 | 3000 |
| 1014411 | N/A | N/A | 11567 | 11582 | CGTGTGCTTGCCAAGC | kk-d9-kdkdk | 47 | 3284 |
| 1014412 | N/A | N/A | 11568 | 11583 | ACGTGTGCTTGCCAAG | kk-d9-kdkdk | 34 | 3285 |
| 1014444 | N/A | N/A | 12514 | 12529 | TTCATGTAAAGTCTGC | kk-d9-kdkdk | 65 | 3286 |
| 1014445 | N/A | N/A | 12515 | 12530 | GTTCATGTAAAGTCTG | kk-d9-kdkdk | 64 | 934 |
| 1014446 | N/A | N/A | 12516 | 12531 | AGTTCATGTAAAGTCT | kk-d9-kdkdk | 53 | 755 |

TABLE 61-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 1014447 | N/A | N/A | 12517 | 12532 | AAGTTCATGTAAAGTC | kk-d9-kdkdk | 66 | 3287 |
| 1014526 | N/A | N/A | 18073 | 18088 | GTTGGCTGGTCTTTGT | kk-d9-kdkdk | 44 | 3336 |
| 1014527 | N/A | N/A | 18074 | 18089 | GGTTGGCTGGTCTTTG | kk-d9-kdkdk | 36 | 3337 |
| 1014528 | N/A | N/A | 18075 | 18090 | TGGTTGGCTGGTCTTT | kk-d9-kdkdk | 49 | 3338 |
| 1014529 | N/A | N/A | 18076 | 18091 | TTGGTTGGCTGGTCTT | kk-d9-kdkdk | 45 | 3339 |
| 1014532 | N/A | N/A | 18087 | 18102 | TTATATACTGGTTGGT | kk-d9-kdkdk | 82 | 1179 |
| 1014533 | N/A | N/A | 18088 | 18103 | ATTATATACTGGTTGG | kk-d9-kdkdk | 72 | 3340 |
| 1014534 | N/A | N/A | 18089 | 18104 | GATTATATACTGGTTG | kk-d9-kdkdk | 65 | 1254 |
| 1014535 | N/A | N/A | 18090 | 18105 | GGATTATATACTGGTT | kk-d9-kdkdk | 41 | 1330 |
| 1014536 | N/A | N/A | 18091 | 18106 | GGGATTATATACTGGT | kk-d9-kdkdk | 59 | 3341 |
| 1014537 | N/A | N/A | 18092 | 18107 | TGGGATTATATACTGG | kk-d9-kdkdk | 75 | 3342 |
| 1014551 | N/A | N/A | 18571 | 18586 | TGATAGCTGAGCTGAT | kk-d9-kdkdk | 122 | 2546 |
| 1014552 | N/A | N/A | 18572 | 18587 | GTGATAGCTGAGCTGA | kk-d9-kdkdk | 66 | 3343 |
| 1014553 | N/A | N/A | 18573 | 18588 | TGTGATAGCTGAGCTG | kk-d9-kdkdk | 53 | 3344 |
| 1014554 | N/A | N/A | 18574 | 18589 | ATGTGATAGCTGAGCT | kk-d9-kdkdk | 73 | 3345 |
| 1014555 | N/A | N/A | 18575 | 18590 | GATGTGATAGCTGAGC | kk-d9-kdkdk | 66 | 3346 |
| 1014556 | N/A | N/A | 18576 | 18591 | TGATGTGATAGCTGAG | kk-d9-kdkdk | 86 | 3347 |
| 1014557 | N/A | N/A | 18577 | 18592 | TTGATGTGATAGCTGA | kk-d9-kdkdk | 64 | 3348 |
| 1014571 | N/A | N/A | 18611 | 18626 | AGTGACTTGCATCCAT | kk-d9-kdkdk | 78 | 3349 |
| 1014572 | N/A | N/A | 18612 | 18627 | CAGTGACTTGCATCCA | kk-d9-kdkdk | 64 | 3350 |
| 1014573 | N/A | N/A | 18613 | 18628 | ACAGTGACTTGCATCC | kk-d9-kdkdk | 82 | 3351 |
| 1014574 | N/A | N/A | 18614 | 18629 | GACAGTGACTTGCATC | kk-d9-kdkdk | 107 | 3352 |
| 1014783 | N/A | N/A | 10142 | 10157 | ATGTTAGCCAATTCCT | kk-d9-eeekk | 94 | 3272 |
| 1014784 | N/A | N/A | 10143 | 10158 | TATGTTAGCCAATTCC | kk-d9-eeekk | 73 | 2991 |
| 1014785 | N/A | N/A | 10144 | 10159 | TTATGTTAGCCAATTC | kk-d9-eeekk | 91 | 3273 |
| 1014786 | N/A | N/A | 10145 | 10160 | TTTATGTTAGCCAATT | kk-d9-eeekk | 79 | 3274 |
| 1014792 | N/A | N/A | 10278 | 10293 | TGTTACCGATGCTTCA | kk-d9-eeekk | 61 | 2294 |
| 1014793 | N/A | N/A | 10279 | 10294 | CTGTTACCGATGCTTC | kk-d9-eeekk | 44 | 2993 |
| 1014794 | N/A | N/A | 10280 | 10295 | ACTGTTACCGATGCTT | kk-d9-eeekk | 66 | 3055 |
| 1014795 | N/A | N/A | 10281 | 10296 | TACTGTTACCGATGCT | kk-d9-eeekk | 92 | 3117 |
| 1014806 | N/A | N/A | 11016 | 11031 | GTGTCTAAAGTCCCAT | kk-d9-eeekk | 123 | 3275 |
| 1014807 | N/A | N/A | 11017 | 11032 | AGTGTCTAAAGTCCCA | kk-d9-eeekk | 88 | 2996 |
| 1014808 | N/A | N/A | 11018 | 11033 | AAGTGTCTAAAGTCCC | kk-d9-eeekk | 54 | 3276 |
| 1014809 | N/A | N/A | 11019 | 11034 | CAAGTGTCTAAAGTCC | kk-d9-eeekk | 69 | 3058 |
| 1014813 | N/A | N/A | 11119 | 11134 | AGCAGTGATGTCAGGT | kk-d9-eeekk | 44 | 2718 |
| 1014814 | N/A | N/A | 11120 | 11135 | AAGCAGTGATGTCAGG | kk-d9-eeekk | 49 | 3277 |

TABLE 61-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 1014815 | N/A | N/A | 11121 | 11136 | CAAGCAGTGATGTCAG | kk-d9-eeekk | 92 | 3278 |
| 1014820 | N/A | N/A | 11395 | 11410 | CACATCAATGTTTTAG | kk-d9-eeekk | 89 | 3279 |
| 1014821 | N/A | N/A | 11396 | 11411 | GCACATCAATGTTTTA | kk-d9-eeekk | 80 | 1159 |
| 1014822 | N/A | N/A | 11397 | 11412 | GGCACATCAATGTTTT | kk-d9-eeekk | 64 | 3280 |
| 1014823 | N/A | N/A | 11398 | 11413 | AGGCACATCAATGTTT | kk-d9-eeekk | 57 | 1233 |
| 1014834 | N/A | N/A | 11411 | 11426 | GTGTATTACTCTTAGG | kk-d9-eeekk | 25 | 1540 |

TABLE 62

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 26 | 195 |
| 881450 | 3252 | 3267 | 21369 | 21384 | ACACTTTTAGAGAGGA | kkk-d10-kkk | 39 | 2111 |
| 881659 | 4592 | 4607 | 22709 | 22724 | GGAAGTTTACACTGGA | kkk-d10-kkk | 9 | 2044 |
| 1014835 | N/A | N/A | 11412 | 11427 | TGTGTATTACTCTTAG | kk-d9-eeekk | 76 | 3246 |
| 1014836 | N/A | N/A | 11413 | 11428 | ATGTGTATTACTCTTA | kk-d9-eeekk | 56 | 3281 |
| 1014837 | N/A | N/A | 11414 | 11429 | AATGTGTATTACTCTT | kk-d9-eeekk | 83 | 3282 |
| 1014850 | N/A | N/A | 11565 | 11580 | TGTGCTTGCCAAGCCT | kk-d9-eeekk | 60 | 3283 |
| 1014851 | N/A | N/A | 11566 | 11581 | GTGTGCTTGCCAAGCC | kk-d9-eeekk | 38 | 3000 |
| 1014852 | N/A | N/A | 11567 | 11582 | CGTGTGCTTGCCAAGC | kk-d9-eeekk | 34 | 3284 |
| 1014853 | N/A | N/A | 11568 | 11583 | ACGTGTGCTTGCCAAG | kk-d9-eeekk | 57 | 3285 |
| 1014885 | N/A | N/A | 12514 | 12529 | TTCATGTAAAGTCTGC | kk-d9-eeekk | 65 | 3286 |
| 1014886 | N/A | N/A | 12515 | 12530 | GTTCATGTAAAGTCTG | kk-d9-eeekk | 76 | 934 |
| 1014887 | N/A | N/A | 12516 | 12531 | AGTTCATGTAAAGTCT | kk-d9-eeekk | 70 | 755 |
| 1014888 | N/A | N/A | 12517 | 12532 | AAGTTCATGTAAAGTC | kk-d9-eeekk | 97 | 3287 |
| 1014967 | N/A | N/A | 18073 | 18088 | GTTGGCTGGTCTTTGT | kk-d9-eeekk | 76 | 3336 |
| 1014968 | N/A | N/A | 18074 | 18089 | GGTTGGCTGGTCTTTG | kk-d9-eeekk | 31 | 3337 |
| 1014969 | N/A | N/A | 18075 | 18090 | TGGTTGGCTGGTCTTT | kk-d9-eeekk | 60 | 3338 |
| 1014970 | N/A | N/A | 18076 | 18091 | TTGGTTGGCTGGTCTT | kk-d9-eeekk | 50 | 3339 |
| 1014973 | N/A | N/A | 18087 | 18102 | TTATATACTGGTTGGT | kk-d9-eeekk | 60 | 1179 |
| 1014974 | N/A | N/A | 18088 | 18103 | ATTATATACTGGTTGG | kk-d9-eeekk | 63 | 3340 |
| 1014975 | N/A | N/A | 18089 | 18104 | GATTATATACTGGTTG | kk-d9-eeekk | 58 | 1254 |
| 1014976 | N/A | N/A | 18090 | 18105 | GGATTATATACTGGTT | kk-d9-eeekk | 22 | 1330 |
| 1014977 | N/A | N/A | 18091 | 18106 | GGGATTATATACTGGT | kk-d9-eeekk | 65 | 3341 |
| 1014978 | N/A | N/A | 18092 | 18107 | TGGGATTATATACTGG | kk-d9-eeekk | 46 | 3342 |
| 1014992 | N/A | N/A | 18571 | 18586 | TGATAGCTGAGCTGAT | kk-d9-eeekk | 102 | 2546 |

TABLE 62-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 1014993 | N/A | N/A | 18572 | 18587 | GTGATAGCTGAGCTGA | kk-d9-eeekk | 87 | 3343 |
| 1014994 | N/A | N/A | 18573 | 18588 | TGTGATAGCTGAGCTG | kk-d9-eeekk | 88 | 3344 |
| 1014995 | N/A | N/A | 18574 | 18589 | ATGTGATAGCTGAGCT | kk-d9-eeekk | 100 | 3345 |
| 1014996 | N/A | N/A | 18575 | 18590 | GATGTGATAGCTGAGC | kk-d9-eeekk | 48 | 3346 |
| 1014997 | N/A | N/A | 18576 | 18591 | TGATGTGATAGCTGAG | kk-d9-eeekk | 53 | 3347 |
| 1014998 | N/A | N/A | 18577 | 18592 | TTGATGTGATAGCTGA | kk-d9-eeekk | 83 | 3348 |
| 1015012 | N/A | N/A | 18611 | 18626 | AGTGACTTGCATCCAT | kk-d9-eeekk | 48 | 3349 |
| 1015013 | N/A | N/A | 18612 | 18627 | CAGTGACTTGCATCCA | kk-d9-eeekk | 72 | 3350 |
| 1015014 | N/A | N/A | 18613 | 18628 | ACAGTGACTTGCATCC | kk-d9-eeekk | 73 | 3351 |
| 1015015 | N/A | N/A | 18614 | 18629 | GACAGTGACTTGCATC | kk-d9-eeekk | 76 | 3352 |
| 1015224 | N/A | N/A | 10142 | 10157 | ATGTTAGCCAATTCCT | kk-d9-ekeke | 70 | 3272 |
| 1015225 | N/A | N/A | 10143 | 10158 | TATGTTAGCCAATTCC | kk-d9-ekeke | 110 | 2991 |
| 1015226 | N/A | N/A | 10144 | 10159 | TTATGTTAGCCAATTC | kk-d9-ekeke | 92 | 3273 |
| 1015227 | N/A | N/A | 10145 | 10160 | TTTATGTTAGCCAATT | kk-d9-ekeke | 113 | 3274 |
| 1015233 | N/A | N/A | 10278 | 10293 | TGTTACCGATGCTTCA | kk-d9-ekeke | 51 | 2294 |
| 1015234 | N/A | N/A | 10279 | 10294 | CTGTTACCGATGCTTC | kk-d9-ekeke | 40 | 2993 |
| 1015235 | N/A | N/A | 10280 | 10295 | ACTGTTACCGATGCTT | kk-d9-ekeke | 63 | 3055 |
| 1015236 | N/A | N/A | 10281 | 10296 | TACTGTTACCGATGCT | kk-d9-ekeke | 86 | 3117 |
| 1015247 | N/A | N/A | 11016 | 11031 | GTGTCTAAAGTCCCAT | kk-d9-ekeke | 77 | 3275 |
| 1015248 | N/A | N/A | 11017 | 11032 | AGTGTCTAAAGTCCCA | kk-d9-ekeke | 81 | 2996 |
| 1015249 | N/A | N/A | 11018 | 11033 | AAGTGTCTAAAGTCCC | kk-d9-ekeke | 101 | 3276 |
| 1015250 | N/A | N/A | 11019 | 11034 | CAAGTGTCTAAAGTCC | kk-d9-ekeke | 75 | 3058 |
| 1015254 | N/A | N/A | 11119 | 11134 | AGCAGTGATGTCAGGT | kk-d9-ekeke | 30 | 2718 |
| 1015255 | N/A | N/A | 11120 | 11135 | AAGCAGTGATGTCAGG | kk-d9-ekeke | 35 | 3277 |
| 1015256 | N/A | N/A | 11121 | 11136 | CAAGCAGTGATGTCAG | kk-d9-ekeke | 66 | 3278 |
| 1015261 | N/A | N/A | 11395 | 11410 | CACATCAATGTTTTAG | kk-d9-ekeke | 73 | 3279 |
| 1015262 | N/A | N/A | 11396 | 11411 | GCACATCAATGTTTTA | kk-d9-ekeke | 88 | 1159 |
| 1015263 | N/A | N/A | 11397 | 11412 | GGCACATCAATGTTTT | kk-d9-ekeke | 74 | 3280 |
| 1015264 | N/A | N/A | 11398 | 11413 | AGGCACATCAATGTTT | kk-d9-ekeke | 65 | 1233 |
| 1015275 | N/A | N/A | 11411 | 11426 | GTGTATTACTCTTAGG | kk-d9-ekeke | 16 | 1540 |
| 1015276 | N/A | N/A | 11412 | 11427 | TGTGTATTACTCTTAG | kk-d9-ekeke | 34 | 3246 |
| 1015277 | N/A | N/A | 11413 | 11428 | ATGTGTATTACTCTTA | kk-d9-ekeke | 39 | 3281 |
| 1015278 | N/A | N/A | 11414 | 11429 | AATGTGTATTACTCTT | kk-d9-ekeke | 70 | 3282 |
| 1015291 | N/A | N/A | 11565 | 11580 | TGTGCTTGCCAAGCCT | kk-d9-ekeke | 99 | 3283 |
| 1015292 | N/A | N/A | 11566 | 11581 | GTGTGCTTGCCAAGCC | kk-d9-ekeke | 81 | 3000 |
| 1015293 | N/A | N/A | 11567 | 11582 | CGTGTGCTTGCCAAGC | kk-d9-ekeke | 64 | 3284 |

TABLE 62-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 1015294 | N/A | N/A | 11568 | 11583 | ACGTGTGCTTGCCAAG | kk-d9-ekeke | 39 | 3285 |
| 1015326 | N/A | N/A | 12514 | 12529 | TTCATGTAAAGTCTGC | kk-d9-ekeke | 61 | 3286 |
| 1015327 | N/A | N/A | 12515 | 12530 | GTTCATGTAAAGTCTG | kk-d9-ekeke | 68 | 934 |
| 1015328 | N/A | N/A | 12516 | 12531 | AGTTCATGTAAAGTCT | kk-d9-ekeke | 51 | 755 |
| 1015329 | N/A | N/A | 12517 | 12532 | AAGTTCATGTAAAGTC | kk-d9-ekeke | 71 | 3287 |
| 1015408 | N/A | N/A | 18073 | 18088 | GTTGGCTGGTCTTTGT | kk-d9-ekeke | 77 | 3336 |
| 1015409 | N/A | N/A | 18074 | 18089 | GGTTGGCTGGTCTTTG | kk-d9-ekeke | 27 | 3337 |
| 1015410 | N/A | N/A | 18075 | 18090 | TGGTTGGCTGGTCTTT | kk-d9-ekeke | 40 | 3338 |
| 1015411 | N/A | N/A | 18076 | 18091 | TTGGTTGGCTGGTCTT | kk-d9-ekeke | 66 | 3339 |
| 1015414 | N/A | N/A | 18087 | 18102 | TTATATACTGGTTGGT | kk-d9-ekeke | 36 | 1179 |
| 1015415 | N/A | N/A | 18088 | 18103 | ATTATATACTGGTTGG | kk-d9-ekeke | 57 | 3340 |
| 1015416 | N/A | N/A | 18089 | 18104 | GATTATATACTGGTTG | kk-d9-ekeke | 54 | 1254 |
| 1015417 | N/A | N/A | 18090 | 18105 | GGATTATATACTGGTT | kk-d9-ekeke | 21 | 1330 |
| 1015418 | N/A | N/A | 18091 | 18106 | GGGATTATATACTGGT | kk-d9-ekeke | 66 | 3341 |
| 1015419 | N/A | N/A | 18092 | 18107 | TGGGATTATATACTGG | kk-d9-ekeke | 37 | 3342 |
| 1015433 | N/A | N/A | 18571 | 18586 | TGATAGCTGAGCTGAT | kk-d9-ekeke | 85 | 2546 |
| 1015434 | N/A | N/A | 18572 | 18587 | GTGATAGCTGAGCTGA | kk-d9-ekeke | 76 | 3343 |
| 1015435 | N/A | N/A | 18573 | 18588 | TGTGATAGCTGAGCTG | kk-d9-ekeke | 59 | 3344 |

TABLE 63

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 33 | 195 |
| 881450 | 3252 | 3267 | 21369 | 21384 | ACACTTTTAGAGAGGA | kkk-d10-kkk | 30 | 2111 |
| 881659 | 4592 | 4607 | 22709 | 22724 | GGAAGTTTACACTGGA | kkk-d10-kkk | 13 | 2044 |
| 1012810 | N/A | N/A | 10142 | 10157 | ATGTTAGCCAATTCCT | kkk-d10-kkk | 67 | 3272 |
| 1012811 | N/A | N/A | 10144 | 10159 | TTATGTTAGCCAATTC | kkk-d10-kkk | 78 | 3273 |
| 1012812 | N/A | N/A | 10145 | 10160 | TTTATGTTAGCCAATT | kkk-d10-kkk | 87 | 3274 |
| 1012816 | N/A | N/A | 11016 | 11031 | GTGTCTAAAGTCCCAT | kkk-d10-kkk | 72 | 3275 |
| 1012817 | N/A | N/A | 11018 | 11033 | AAGTGTCTAAAGTCCC | kkk-d10-kkk | 59 | 3276 |
| 1012819 | N/A | N/A | 11120 | 11135 | AAGCAGTGATGTCAGG | kkk-d10-kkk | 34 | 3277 |
| 1012820 | N/A | N/A | 11121 | 11136 | CAAGCAGTGATGTCAG | kkk-d10-kkk | 49 | 3278 |
| 1012821 | N/A | N/A | 11395 | 11410 | CACATCAATGTTTTAG | kkk-d10-kkk | 25 | 3279 |
| 1012822 | N/A | N/A | 11397 | 11412 | GGCACATCAATGTTTT | kkk-d10-kkk | 86 | 3280 |
| 1012826 | N/A | N/A | 11413 | 11428 | ATGTGTATTACTCTTA | kkk-d10-kkk | 51 | 3281 |

TABLE 63-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 1012827 | N/A | N/A | 11414 | 11429 | AATGTGTATTACTCTT | kkk-d10-kkk | 59 | 3282 |
| 1012835 | N/A | N/A | 11565 | 11580 | TGTGCTTGCCAAGCCT | kkk-d10-kkk | 51 | 3283 |
| 1012836 | N/A | N/A | 11567 | 11582 | CGTGTGCTTGCCAAGC | kkk-d10-kkk | 34 | 3284 |
| 1012837 | N/A | N/A | 11568 | 11583 | ACGTGTGCTTGCCAAG | kkk-d10-kkk | 45 | 3285 |
| 1012845 | N/A | N/A | 12514 | 12529 | TTCATGTAAAGTCTGC | kkk-d10-kkk | 45 | 3286 |
| 1012846 | N/A | N/A | 12517 | 12532 | AAGTTCATGTAAAGTC | kkk-d10-kkk | 59 | 3287 |
| 1015436 | N/A | N/A | 18574 | 18589 | ATGTGATAGCTGAGCT | kk-d9-ekeke | 98 | 3345 |
| 1015437 | N/A | N/A | 18575 | 18590 | GATGTGATAGCTGAGC | kk-d9-ekeke | 47 | 3346 |
| 1015438 | N/A | N/A | 18576 | 18591 | TGATGTGATAGCTGAG | kk-d9-ekeke | 40 | 3347 |
| 1015439 | N/A | N/A | 18577 | 18592 | TTGATGTGATAGCTGA | kk-d9-ekeke | 72 | 3348 |
| 1015453 | N/A | N/A | 18611 | 18626 | AGTGACTTGCATCCAT | kk-d9-ekeke | 66 | 3349 |
| 1015454 | N/A | N/A | 18612 | 18627 | CAGTGACTTGCATCCA | kk-d9-ekeke | 66 | 3350 |
| 1015455 | N/A | N/A | 18613 | 18628 | ACAGTGACTTGCATCC | kk-d9-ekeke | 91 | 3351 |
| 1015456 | N/A | N/A | 18614 | 18629 | GACAGTGACTTGCATC | kk-d9-ekeke | 70 | 3352 |
| 1015665 | N/A | N/A | 10142 | 10157 | ATGTTAGCCAATTCCT | k-d9-kekeke | 95 | 3272 |
| 1015666 | N/A | N/A | 10143 | 10158 | TATGTTAGCCAATTCC | k-d9-kekeke | 86 | 2991 |
| 1015667 | N/A | N/A | 10144 | 10159 | TTATGTTAGCCAATTC | k-d9-kekeke | 98 | 3273 |
| 1015668 | N/A | N/A | 10145 | 10160 | TTTATGTTAGCCAATT | k-d9-kekeke | 86 | 3274 |
| 1015674 | N/A | N/A | 10278 | 10293 | TGTTACCGATGCTTCA | k-d9-kekeke | 87 | 2294 |
| 1015675 | N/A | N/A | 10279 | 10294 | CTGTTACCGATGCTTC | k-d9-kekeke | 76 | 2993 |
| 1015676 | N/A | N/A | 10280 | 10295 | ACTGTTACCGATGCTT | k-d9-kekeke | 83 | 3055 |
| 1015677 | N/A | N/A | 10281 | 10296 | TACTGTTACCGATGCT | k-d9-kekeke | 82 | 3117 |
| 1015688 | N/A | N/A | 11016 | 11031 | GTGTCTAAAGTCCCAT | k-d9-kekeke | 95 | 3275 |
| 1015689 | N/A | N/A | 11017 | 11032 | AGTGTCTAAAGTCCCA | k-d9-kekeke | 88 | 2996 |
| 1015690 | N/A | N/A | 11018 | 11033 | AAGTGTCTAAAGTCCC | k-d9-kekeke | 95 | 3276 |
| 1015691 | N/A | N/A | 11019 | 11034 | CAAGTGTCTAAAGTCC | k-d9-kekeke | 90 | 3058 |
| 1015695 | N/A | N/A | 11119 | 11134 | AGCAGTGATGTCAGGT | k-d9-kekeke | 64 | 2718 |
| 1015696 | N/A | N/A | 11120 | 11135 | AAGCAGTGATGTCAGG | k-d9-kekeke | 65 | 3277 |
| 1015697 | N/A | N/A | 11121 | 11136 | CAAGCAGTGATGTCAG | k-d9-kekeke | 88 | 3278 |
| 1015702 | N/A | N/A | 11395 | 11410 | CACATCAATGTTTTAG | k-d9-kekeke | 82 | 3279 |
| 1015703 | N/A | N/A | 11396 | 11411 | GCACATCAATGTTTTA | k-d9-kekeke | 85 | 1159 |
| 1015704 | N/A | N/A | 11397 | 11412 | GGCACATCAATGTTTT | k-d9-kekeke | 94 | 3280 |
| 1015705 | N/A | N/A | 11398 | 11413 | AGGCACATCAATGTTT | k-d9-kekeke | 97 | 1233 |

TABLE 63-continued

Percent control of human IRF4 mRNA with gapmers
with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 1015716 | N/A | N/A | 11411 | 11426 | GTGTATTACTCTTAGG | k-d9-kekeke | 23 | 1540 |
| 1015717 | N/A | N/A | 11412 | 11427 | TGTGTATTACTCTTAG | k-d9-kekeke | 48 | 3246 |
| 1015718 | N/A | N/A | 11413 | 11428 | ATGTGTATTACTCTTA | k-d9-kekeke | 51 | 3281 |
| 1015719 | N/A | N/A | 11414 | 11429 | AATGTGTATTACTCTT | k-d9-kekeke | 85 | 3282 |
| 1015732 | N/A | N/A | 11565 | 11580 | TGTGCTTGCCAAGCCT | k-d9-kekeke | 84 | 3283 |
| 1015733 | N/A | N/A | 11566 | 11581 | GTGTGCTTGCCAAGCC | k-d9-kekeke | 78 | 3000 |
| 1015734 | N/A | N/A | 11567 | 11582 | CGTGTGCTTGCCAAGC | k-d9-kekeke | 89 | 3284 |
| 1015735 | N/A | N/A | 11568 | 11583 | ACGTGTGCTTGCCAAG | k-d9-kekeke | 65 | 3285 |
| 1015767 | N/A | N/A | 12514 | 12529 | TTCATGTAAAGTCTGC | k-d9-kekeke | 97 | 3286 |
| 1015768 | N/A | N/A | 12515 | 12530 | GTTCATGTAAAGTCTG | k-d9-kekeke | 90 | 934 |
| 1015769 | N/A | N/A | 12516 | 12531 | AGTTCATGTAAAGTCT | k-d9-kekeke | 90 | 755 |
| 1015770 | N/A | N/A | 12517 | 12532 | AAGTTCATGTAAAGTC | k-d9-kekeke | 79 | 3287 |
| 1015849 | N/A | N/A | 18073 | 18088 | GTTGGCTGGTCTTTGT | k-d9-kekeke | 82 | 3336 |
| 1015850 | N/A | N/A | 18074 | 18089 | GGTTGGCTGGTCTTTG | k-d9-kekeke | 74 | 3337 |
| 1015851 | N/A | N/A | 18075 | 18090 | TGGTTGGCTGGTCTTT | k-d9-kekeke | 69 | 3338 |
| 1015852 | N/A | N/A | 18076 | 18091 | TTGGTTGGCTGGTCTT | k-d9-kekeke | 107 | 3339 |
| 1015855 | N/A | N/A | 18087 | 18102 | TTATATACTGGTTGGT | k-d9-kekeke | 80 | 1179 |
| 1015856 | N/A | N/A | 18088 | 18103 | ATTATATACTGGTTGG | k-d9-kekeke | 73 | 3340 |
| 1015857 | N/A | N/A | 18089 | 18104 | GATTATATACTGGTTG | k-d9-kekeke | 88 | 1254 |
| 1015858 | N/A | N/A | 18090 | 18105 | GGATTATATACTGGTT | k-d9-kekeke | 90 | 1330 |
| 1015859 | N/A | N/A | 18091 | 18106 | GGGATTATATACTGGT | k-d9-kekeke | 71 | 3341 |
| 1015860 | N/A | N/A | 18092 | 18107 | TGGGATTATATACTGG | k-d9-kekeke | 60 | 3342 |
| 1015874 | N/A | N/A | 18571 | 18586 | TGATAGCTGAGCTGAT | k-d9-kekeke | 83 | 2546 |
| 1015875 | N/A | N/A | 18572 | 18587 | GTGATAGCTGAGCTGA | k-d9-kekeke | 84 | 3343 |
| 1015876 | N/A | N/A | 18573 | 18588 | TGTGATAGCTGAGCTG | k-d9-kekeke | 82 | 3344 |
| 1015877 | N/A | N/A | 18574 | 18589 | ATGTGATAGCTGAGCT | k-d9-kekeke | 85 | 3345 |
| 1015878 | N/A | N/A | 18575 | 18590 | GATGTGATAGCTGAGC | k-d9-kekeke | 82 | 3346 |
| 1015879 | N/A | N/A | 18576 | 18591 | TGATGTGATAGCTGAG | k-d9-kekeke | 53 | 3347 |
| 1015880 | N/A | N/A | 18577 | 18592 | TTGATGTGATAGCTGA | k-d9-kekeke | 66 | 3348 |
| 1015894 | N/A | N/A | 18611 | 18626 | AGTGACTTGCATCCAT | k-d9-kekeke | 92 | 3349 |
| 1015895 | N/A | N/A | 18612 | 18627 | CAGTGACTTGCATCCA | k-d9-kekeke | 81 | 3350 |
| 1015896 | N/A | N/A | 18613 | 18628 | ACAGTGACTTGCATCC | k-d9-kekeke | 94 | 3351 |
| 1015897 | N/A | N/A | 18614 | 18629 | GACAGTGACTTGCATC | k-d9-kekeke | 100 | 3352 |

TABLE 64

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 609408 | 4226 | 4241 | 22343 | 22358 | TTGTAAATGAGTCGGT | kkk-d10-kkk | 23 | 195 |
| 881450 | 3252 | 3267 | 21369 | 21384 | ACACTTTTAGAGAGGA | kkk-d10-kkk | 35 | 2111 |
| 881659 | 4592 | 4607 | 22709 | 22724 | GGAAGTTTACACTGGA | kkk-d10-kkk | 9 | 2044 |
| 935595 | 3075 | 3090 | 21192 | 21207 | ACTAAGCTTGATAAAG | kkk-d10-kkk | 95 | 3288 |
| 935607 | 4195 | 4210 | 22312 | 22327 | AGTGTTCCAGGAGATA | kkk-d10-kkk | 28 | 3289 |
| 1012769 | N/A | N/A | 4810 | 4825 | GCTCCCGACACGCGCC | kkk-d10-kkk | 81 | 3290 |
| 1012772 | N/A | N/A | 6267 | 6282 | ATGCGGAGGTTCCTTG | kkk-d10-kkk | 48 | 3291 |
| 1012774 | N/A | N/A | 6271 | 6286 | TGAGATGCGGAGGTTC | kkk-d10-kkk | 73 | 3292 |
| 1012775 | N/A | N/A | 6273 | 6288 | AGTGAGATGCGGAGGT | kkk-d10-kkk | 35 | 3293 |
| 1012776 | N/A | N/A | 6275 | 6290 | AGAGTGAGATGCGGAG | kkk-d10-kkk | 37 | 3294 |
| 1012778 | N/A | N/A | 6281 | 6296 | ACCGGTAGAGTGAGAT | kkk-d10-kkk | 98 | 3295 |
| 1012782 | N/A | N/A | 7634 | 7649 | GAGTTGTACAGGACAG | kkk-d10-kkk | 48 | 3296 |
| 1012785 | N/A | N/A | 7638 | 7653 | GTCTGAGTTGTACAGG | kkk-d10-kkk | 43 | 3297 |
| 1012786 | N/A | N/A | 7640 | 7655 | AGGTCTGAGTTGTACA | kkk-d10-kkk | 55 | 3298 |
| 1012788 | N/A | N/A | 8386 | 8401 | AATGGAGATACTTGTA | kkk-d10-kkk | 74 | 3299 |
| 1012790 | N/A | N/A | 8389 | 8404 | GACAATGGAGATACTT | kkk-d10-kkk | 63 | 3300 |
| 1012795 | N/A | N/A | 9667 | 9682 | GTATTTTTCCGTTCCT | kkk-d10-kkk | 16 | 3303 |
| 1012796 | N/A | N/A | 9670 | 9685 | ATGGTATTTTTCCGTT | kkk-d10-kkk | 57 | 3304 |
| 1012799 | N/A | N/A | 9677 | 9692 | GTTTGCCATGGTATTT | kkk-d10-kkk | 50 | 3305 |
| 1012804 | N/A | N/A | 9840 | 9855 | CATTGCTAGATTCTCC | kkk-d10-kkk | 70 | 3306 |
| 1012806 | N/A | N/A | 9846 | 9861 | TTACCGCATTGCTAGA | kkk-d10-kkk | 74 | 3307 |
| 1012808 | N/A | N/A | 9851 | 9866 | CTGAGTTACCGCATTG | kkk-d10-kkk | 46 | 3308 |
| 1012809 | N/A | N/A | 10139 | 10154 | TTAGCCAATTCCTCCA | kkk-d10-kkk | 53 | 3309 |
| 1012813 | N/A | N/A | 10274 | 10289 | ACCGATGCTTCAAGAC | kkk-d10-kkk | 44 | 3310 |
| 1012814 | N/A | N/A | 10276 | 10291 | TTACCGATGCTTCAAG | kkk-d10-kkk | 81 | 3311 |
| 1012815 | N/A | N/A | 10282 | 10297 | TTACTGTTACCGATGC | kkk-d10-kkk | 65 | 3312 |
| 1012818 | N/A | N/A | 11020 | 11035 | GCAAGTGTCTAAAGTC | kkk-d10-kkk | 47 | 3313 |
| 1012823 | N/A | N/A | 11400 | 11415 | TTAGGCACATCAATGT | kkk-d10-kkk | 83 | 3314 |
| 1012825 | N/A | N/A | 11406 | 11421 | TTACTCTTAGGCACAT | kkk-d10-kkk | 55 | 3315 |
| 1012828 | N/A | N/A | 11523 | 11538 | GATCTCCATGGTGCAG | kkk-d10-kkk | 88 | 3316 |
| 1012831 | N/A | N/A | 11530 | 11545 | TAGGTAAGATCTCCAT | kkk-d10-kkk | 67 | 3317 |
| 1012834 | N/A | N/A | 11564 | 11579 | GTGCTTGCCAAGCCTA | kkk-d10-kkk | 64 | 3318 |
| 1012840 | N/A | N/A | 11659 | 11674 | CCAAACCTTAAGCTAT | kkk-d10-kkk | 66 | 3319 |
| 1012841 | N/A | N/A | 11663 | 11678 | AATTCCAAACCTTAAG | kkk-d10-kkk | 74 | 3320 |
| 1012843 | N/A | N/A | 11995 | 12010 | AGGTTGCCGAGATATA | kkk-d10-kkk | 33 | 3321 |
| 1012844 | N/A | N/A | 11997 | 12012 | CGAGGTTGCCGAGATA | kkk-d10-kkk | 40 | 3322 |
| 1012848 | N/A | N/A | 14251 | 14266 | GAGCCAACTTATAGCA | kkk-d10-kkk | 92 | 3323 |

TABLE 64-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID: 2 Stop Site | Sequence | Motif | IRF4 (% UTC) | SEQ ID NO |
|---|---|---|---|---|---|---|---|---|
| 1012850 | N/A | N/A | 14253 | 14268 | CAGAGCCAACTTATAG | kkk-d10-kkk | 57 | 3324 |
| 1012852 | N/A | N/A | 14734 | 14749 | GAAGCTTAGTTATCTG | kkk-d10-kkk | 61 | 3325 |
| 1012855 | N/A | N/A | 14739 | 14754 | GGCCTGAAGCTTAGTT | kkk-d10-kkk | 94 | 3326 |
| 1012859 | N/A | N/A | 15594 | 15609 | GTCGCGCAAGTCTACA | kkk-d10-kkk | 84 | 3327 |
| 1012860 | N/A | N/A | 15841 | 15856 | GTTGGCACAATTCTCT | kkk-d10-kkk | 84 | 3328 |
| 1012864 | N/A | N/A | 15845 | 15860 | GCGAGTTGGCACAATT | kkk-d10-kkk | 63 | 3329 |
| 1012866 | N/A | N/A | 15848 | 15863 | ATGGCGAGTTGGCACA | kkk-d10-kkk | 52 | 3330 |
| 1012867 | N/A | N/A | 15850 | 15865 | GAATGGCGAGTTGGCA | kkk-d10-kkk | 60 | 3331 |
| 1012869 | N/A | N/A | 15884 | 15899 | CGTGATCTGAGACTAC | kkk-d10-kkk | 64 | 3332 |
| 1012872 | N/A | N/A | 15889 | 15904 | ACTGCCGTGATCTGAG | kkk-d10-kkk | 71 | 3333 |
| 1012875 | N/A | N/A | 17236 | 17251 | TTACGCTTATTTTTCC | kkk-d10-kkk | 61 | 3353 |
| 1012879 | N/A | N/A | 17473 | 17488 | CAATCTTAACCTGGAG | kkk-d10-kkk | 60 | 3354 |
| 1012881 | N/A | N/A | 18073 | 18088 | GTTGGCTGGTCTTTGT | kkk-d10-kkk | 37 | 3336 |
| 1012882 | N/A | N/A | 18075 | 18090 | TGGTTGGCTGGTCTTT | kkk-d10-kkk | 12 | 3338 |
| 1012883 | N/A | N/A | 18076 | 18091 | TTGGTTGGCTGGTCTT | kkk-d10-kkk | 24 | 3339 |
| 1012884 | N/A | N/A | 18083 | 18098 | ATACTGGTTGGTTGGC | kkk-d10-kkk | 31 | 3355 |
| 1012885 | N/A | N/A | 18250 | 18265 | GCCGATCATCAACTTC | kkk-d10-kkk | 74 | 3356 |
| 1012888 | N/A | N/A | 18254 | 18269 | CCCGGCCGATCATCAA | kkk-d10-kkk | 77 | 3357 |
| 1012889 | N/A | N/A | 18569 | 18584 | ATAGCTGAGCTGATCA | kkk-d10-kkk | 70 | 3358 |
| 1012890 | N/A | N/A | 18573 | 18588 | TGTGATAGCTGAGCTG | kkk-d10-kkk | 53 | 3344 |
| 1012891 | N/A | N/A | 18574 | 18589 | ATGTGATAGCTGAGCT | kkk-d10-kkk | 74 | 3345 |
| 1012892 | N/A | N/A | 18576 | 18591 | TGATGTGATAGCTGAG | kkk-d10-kkk | 41 | 3347 |
| 1012893 | N/A | N/A | 18577 | 18592 | TTGATGTGATAGCTGA | kkk-d10-kkk | 45 | 3348 |
| 1012895 | N/A | N/A | 18581 | 18596 | TGGATTGATGTGATAG | kkk-d10-kkk | 52 | 3359 |
| 1012897 | N/A | N/A | 18607 | 18622 | ACTTGCATCCATGTCA | kkk-d10-kkk | 65 | 3360 |
| 1012899 | N/A | N/A | 18610 | 18625 | GTGACTTGCATCCATG | kkk-d10-kkk | 38 | 3361 |
| 1012900 | N/A | N/A | 18611 | 18626 | AGTGACTTGCATCCAT | kkk-d10-kkk | 33 | 3349 |
| 1012901 | N/A | N/A | 18613 | 18628 | ACAGTGACTTGCATCC | kkk-d10-kkk | 66 | 3351 |
| 1012902 | N/A | N/A | 18614 | 18629 | GACAGTGACTTGCATC | kkk-d10-kkk | 76 | 3352 |
| 1012903 | N/A | N/A | 18722 | 18737 | AAGTGGAACTCATAGG | kkk-d10-kkk | 75 | 3362 |
| 1012904 | N/A | N/A | 19021 | 19036 | ATCTGTATAGTTCTCA | kkk-d10-kkk | 45 | 3363 |
| 1012906 | N/A | N/A | 19023 | 19038 | TAATCTGTATAGTTCT | kkk-d10-kkk | 58 | 3364 |
| 1012907 | 1344 | 1359 | 19461 | 19476 | TCTGGCTAGCAGAGGT | kkk-d10-kkk | 74 | 3365 |
| 1012911 | 1412 | 1427 | 19529 | 19544 | ATGTGTTCTGGTAAAT | kkk-d10-kkk | 66 | 3366 |
| 1012914 | 1422 | 1437 | 19539 | 19554 | TGGATTGCTGATGTGT | kkk-d10-kkk | 29 | 3367 |
| 1012915 | 1424 | 1439 | 19541 | 19556 | TCTGGATTGCTGATGT | kkk-d10-kkk | 64 | 3368 |

TABLE 64-continued

Percent control of human IRF4 mRNA with gapmers with phosphorothioate internucleoside linkages

| Compound Number | SEQ ID: 1 Start Site | SEQ ID: 1 Stop Site | SEQ ID: 2 Start Site | SEQ ID 2: Stop Site | Sequence | Motif | IRF4 (% UTC) | SEQ ID NO |
|---|---|---|---|---|---|---|---|---|
| 1012918 | 1427 | 1442 | 19544 | 19559 | TCTTCTGGATTGCTGA | kkk-d10-kkk | 80 | 3369 |
| 1012919 | 1429 | 1444 | 19546 | 19561 | AATCTTCTGGATTGCT | kkk-d10-kkk | 86 | 3370 |
| 1012920 | 1441 | 1456 | 19558 | 19573 | TAGATCTGTGGTAATC | kkk-d10-kkk | 94 | 3334 |
| 1012921 | 1450 | 1465 | 19567 | 19582 | AATGGCGGATAGATCT | kkk-d10-kkk | 75 | 3335 |

Example 12: Effect of Modified Oligonucleotides on Human IRF4 In Vitro, Multiple Doses Modified oligonucleotides selected from the examples above were tested at various doses in SK-MEL-28 cells. Cells were plated at a density of 20,000 cells per well and transfected using electroporation with 185 nM, 555 nM, 1,666 nM, 5,000 nM, and 15,000 nM concentrations of modified oligonucleotide, as specified in the tables below. After a treatment period of approximately 24 hours, RNA was isolated from the cells and IRF4 mRNA levels were measured by RT-qPCR. Human IRF4 primer probe set RTS3114 (described hereinabove in Example 1) was used to measure mRNA levels. IRF4 mRNA levels were adjusted according to total RNA content, as measured by RiboGreen. Results are presented as the percent level of IRF4 mRNA transcript, relative to that of untreated control (UTC) cells. As illustrated in the tables below, IRF4 mRNA levels were reduced in a dose-dependent manner in cells treated with modified oligonucleotides.

TABLE 65

Dose-dependent reduction of human IRF4 mRNA by modified oligonucleotides

| Compound Number | IRF4 expression (% LTC) | | | | |
|---|---|---|---|---|---|
| | 185 nM | 555 nM | 1,666 nM | 5,000 nM | 15,000 nM |
| 609311 | 91 | 79 | 68 | 36 | 9 |
| 609312 | 93 | 91 | 78 | 42 | 13 |
| 609328 | 99 | 73 | 57 | 37 | 14 |
| 609332 | 99 | 92 | 62 | 38 | 15 |
| 609333 | 90 | 82 | 59 | 32 | 11 |
| 609334 | 80 | 71 | 50 | 30 | 11 |
| 609337 | 84 | 81 | 57 | 40 | 15 |
| 609343 | 87 | 80 | 56 | 26 | 11 |
| 609354 | 87 | 79 | 46 | 25 | 10 |
| 609357 | 85 | 80 | 50 | 29 | 9 |
| 609391 | 94 | 82 | 53 | 28 | 10 |
| 609398 | 81 | 77 | 39 | 24 | 8 |
| 609407 | 80 | 71 | 40 | 25 | 11 |
| 609408 | 102 | 73 | 49 | 19 | 12 |

TABLE 66

Dose-dependent reduction of human IRF4 mRNA by modified oligonucleotides

| Compound Number | IRF4 expression (% UTC) | | | | |
|---|---|---|---|---|---|
| | 185 nM | 555 nM | 1,666 nM | 5,000 nM | 15,000 nM |
| 609394 | 94 | 82 | 59 | 52 | 22 |
| 609397 | 86 | 77 | 57 | 42 | 24 |

TABLE 66-continued

Dose-dependent reduction of human IRF4 mRNA by modified oligonucleotides

| Compound Number | IRF4 expression (% UTC) | | | | |
|---|---|---|---|---|---|
| | 185 nM | 555 nM | 1,666 nM | 5,000 nM | 15,000 nM |
| 609405 | 84 | 86 | 75 | 40 | 36 |
| 609408 | 100 | 92 | 62 | 33 | 27 |
| 609416 | 89 | 80 | 54 | 43 | 17 |
| 609419 | 84 | 75 | 66 | 44 | 19 |
| 609422 | 104 | 87 | 69 | 50 | 14 |
| 609530 | 96 | 99 | 78 | 71 | 49 |
| 609533 | 96 | 91 | 80 | 55 | 37 |
| 609546 | 96 | 107 | 84 | 66 | 25 |
| 609571 | 94 | 86 | 78 | 58 | 38 |
| 609591 | 102 | 95 | 94 | 50 | 19 |
| 609592 | 98 | 89 | 67 | 43 | 31 |
| 609594 | 86 | 73 | 68 | 43 | 26 |

TABLE 67

Dose-dependent reduction of human IRF4 mRNA by modified oligonucleotides

| Compound Number | IRF4 expression (% UTC) | | | | |
|---|---|---|---|---|---|
| | 185 nM | 555 nM | 1,666 nM | 5,000 nM | 15,000 nM |
| 609394 | 95 | 76 | 60 | 52 | 20 |
| 609397 | 90 | 74 | 59 | 45 | 22 |
| 609405 | 96 | 82 | 77 | 46 | 37 |
| 609408 | 99 | 84 | 62 | 39 | 27 |
| 609416 | 95 | 76 | 51 | 39 | 21 |
| 609419 | 96 | 73 | 71 | 41 | 18 |
| 609422 | 90 | 83 | 82 | 48 | 17 |
| 609530 | 104 | 99 | 81 | 74 | 45 |
| 609533 | 91 | 97 | 79 | 58 | 32 |
| 609546 | 91 | 88 | 85 | 63 | 28 |
| 609571 | 96 | 95 | 78 | 56 | 35 |
| 609591 | 110 | 83 | 76 | 49 | 21 |
| 609592 | 94 | 88 | 73 | 43 | 38 |
| 609594 | 87 | 84 | 68 | 45 | 28 |

TABLE 68

Dose-dependent reduction of human IRF4 mRNA by modified oligonucleotides

| Compound Number | IRF4 expression (% UTC) | | | | |
|---|---|---|---|---|---|
| | 185 nM | 555 nM | 1,666 nM | 5,000 nM | 15,000 nM |
| 609394 | 101 | 94 | 61 | 25 | 6 |
| 609397 | 99 | 75 | 46 | 23 | 13 |

TABLE 68-continued

Dose-dependent reduction of human IRF4 mRNA by modified oligonucleotides

| Compound Number | IRF4 expression (% UTC) | | | | |
|---|---|---|---|---|---|
| | 185 nM | 555 nM | 1,666 nM | 5,000 nM | 15,000 nM |
| 609405 | 97 | 80 | 53 | 17 | 4 |
| 609408 | 87 | 88 | 39 | 15 | 5 |
| 609416 | 99 | 83 | 47 | 18 | 6 |
| 609419 | 88 | 84 | 54 | 23 | 9 |
| 609422 | 111 | 92 | 66 | 17 | 2 |
| 609530 | 100 | 92 | 63 | 37 | 17 |
| 609533 | 92 | 84 | 65 | 38 | 19 |
| 609546 | 83 | 97 | 72 | 50 | 11 |
| 609571 | 94 | 90 | 72 | 47 | 17 |
| 609591 | 103 | 88 | 53 | 24 | 9 |
| 609592 | 90 | 90 | 55 | 24 | 8 |
| 609594 | 82 | 75 | 52 | 33 | 28 |

Example 13: Effect of Modified Oligonucleotides on Human IRF4 In Vitro, Multiple Doses Modified oligonucleotides selected from the examples above were tested at various doses in SK-MEL-28 cells. Cells were plated at a density of 20,000 cells per well and transfected using electroporation with 500 nM, 1,000 nM, 2,000 nM, 4,000 nM, and 8,000 nM concentrations of modified oligonucleotide, as specified in the tables below. After a treatment period of approximately 24 hours, RNA was isolated from the cells and IRF4 mRNA levels were measured by RT-qPCR. Human IRF4 primer probe set RTS3114 (described hereinabove in Example 1) was used to measure mRNA levels. IRF4 mRNA levels were adjusted according to total RNA content, as measured by RiboGreen. Results are presented as the percent level of IRF4 mRNA transcript, relative to that of untreated control (UTC) cells. As illustrated in the tables below, IRF4 mRNA levels were reduced in a dose-dependent manner in cells treated with modified oligonucleotides.

TABLE 69

Dose-dependent reduction of human IRF4 mRNA by modified oligonucleotides

| Compound Number | IRF4 expression (% UTC) | | | | |
|---|---|---|---|---|---|
| | 500 nM | 1,000 nM | 2,000 nM | 4,000 nM | 8,000 nM |
| 609408 | 70 | 52 | 46 | 26 | 29 |
| 666273 | 85 | 97 | 76 | 53 | 27 |
| 666333 | 77 | 78 | 64 | 42 | 24 |
| 666347 | 80 | 74 | 56 | 37 | 19 |
| 666351 | 79 | 68 | 59 | 53 | 24 |
| 666378 | 71 | 57 | 43 | 28 | 20 |
| 666392 | 77 | 64 | 42 | 37 | 34 |
| 666431 | 85 | 69 | 47 | 41 | 24 |
| 666440 | 69 | 55 | 38 | 21 | 27 |
| 666441 | 79 | 60 | 47 | 29 | 26 |
| 666442 | 62 | 50 | 35 | 21 | 19 |
| 666443 | 71 | 62 | 46 | 32 | 13 |
| 666449 | 53 | 47 | 31 | 20 | 19 |
| 666458 | 69 | 52 | 41 | 22 | 25 |
| 666471 | 57 | 50 | 23 | 23 | 11 |

TABLE 70

Dose-dependent reduction of human IRF4 mRNA by modified oligonucleotides

| Compound Number | IRF4 expression (% UTC) | | | | |
|---|---|---|---|---|---|
| | 500 nM | 1,000 nM | 2,000 nM | 4,000 nM | 8,000 nM |
| 609408 | 71 | 58 | 47 | 37 | 19 |
| 666475 | 54 | 42 | 26 | 22 | 32 |
| 666496 | 54 | 45 | 30 | 18 | 13 |
| 666512 | 76 | 70 | 49 | 29 | 36 |
| 666534 | 64 | 55 | 33 | 19 | 9 |
| 666575 | 71 | 53 | 31 | 24 | 34 |
| 666582 | 80 | 58 | 45 | 28 | 30 |
| 666584 | 88 | 63 | 58 | 35 | 21 |
| 666586 | 49 | 28 | 29 | 19 | 21 |
| 666587 | 61 | 44 | 26 | 14 | 19 |
| 666605 | 68 | 55 | 38 | 32 | 18 |
| 666625 | 71 | 63 | 45 | 30 | 17 |
| 666640 | 73 | 59 | 39 | 42 | 18 |
| 666645 | 83 | 64 | 55 | 37 | 34 |
| 666649 | 80 | 55 | 48 | 35 | 21 |

TABLE 71

Dose-dependent reduction of human IRF4 mRNA by modified oligonucleotides

| Compound Number | IRF4 expression (% UTC) | | | | |
|---|---|---|---|---|---|
| | 500 nM | 1,000 nM | 2,000 nM | 4,000 nM | 8,000 nM |
| 609408 | 74 | 57 | 65 | 47 | 23 |
| 666663 | 78 | 78 | 43 | 34 | 67 |
| 666664 | 77 | 64 | 43 | 31 | 62 |
| 666678 | 57 | 42 | 23 | 25 | 59 |
| 666681 | 74 | 59 | 47 | 28 | 60 |
| 666683 | 64 | 47 | 35 | 38 | 55 |
| 666714 | 81 | 77 | 54 | 47 | 75 |
| 666726 | 75 | 60 | 33 | 28 | 56 |
| 666727 | 83 | 65 | 42 | 31 | 72 |
| 666769 | 98 | 94 | 94 | 87 | 71 |
| 666773 | 83 | 81 | 71 | 47 | 36 |
| 666782 | 78 | 79 | 49 | 44 | 23 |
| 666787 | 75 | 66 | 44 | 32 | 26 |
| 666792 | 84 | 75 | 61 | 46 | 32 |
| 666815 | 81 | 80 | 47 | 50 | 32 |

Example 14: Effect of Modified Oligonucleotides on Human IRF4 In Vitro, Multiple Doses Modified oligonucleotides selected from the examples above were tested at various doses in SK-MEL-28 cells. Cells were plated at a density of 20,000 cells per well and transfected using electroporation with 296 nM, 888 nM, 2,666 nM, and 8,000 nM concentrations of modified oligonucleotide, as specified in the tables below. After a treatment period of approximately 24 hours, RNA was isolated from the cells and IRF4 mRNA levels were measured by RT-qPCR. Human IRF4 primer probe set RTS3114 (described hereinabove in Example 1) was used to measure mRNA levels. IRF4 mRNA levels were adjusted according to total RNA content, as measured by RiboGreen. Results are presented as the percent level of IRF4 mRNA transcript, relative to that of untreated control (UTC) cells. As illustrated in the tables below, IRF4 mRNA levels were reduced in a dose-dependent manner in cells treated with modified oligonucleotides.

TABLE 72

Dose-dependent reduction of human IRF4 mRNA by modified oligonucleotides

| Compound Number | IRF4 expression (% UTC) | | | | IC$_{50}$ (μM) |
|---|---|---|---|---|---|
| | 296 nM | 888 nM | 2,666 nM | 8,000 nM | |
| 609408 | 96 | 53 | 25 | 9 | 1.3 |
| 881193 | 90 | 72 | 54 | 23 | 2.5 |
| 881218 | 86 | 70 | 44 | 38 | 2.9 |
| 881242 | 106 | 65 | 38 | 27 | 2.2 |
| 881290 | 77 | 56 | 44 | 27 | 1.6 |
| 881385 | 99 | 106 | 84 | 54 | >8.0 |
| 881409 | 91 | 82 | 51 | 28 | 2.9 |
| 881434 | 78 | 59 | 29 | 14 | 1.2 |
| 881506 | 61 | 37 | 15 | 11 | 0.5 |
| 881667 | 80 | 63 | 41 | 16 | 1.5 |
| 881993 | 94 | 101 | 73 | 43 | >8.0 |
| 882066 | 99 | 72 | 53 | 25 | 2.7 |
| 882325 | 76 | 55 | 36 | 31 | 1.5 |
| 882326 | 79 | 73 | 42 | 31 | 2.3 |
| 882398 | 83 | 56 | 32 | 16 | 1.3 |
| 882699 | 88 | 81 | 65 | 50 | >8.0 |
| 882722 | 97 | 102 | 84 | 58 | >8.0 |
| 882818 | 134 | 94 | 75 | 31 | 4.8 |
| 882898 | 80 | 66 | 48 | 26 | 2.1 |

TABLE 73

Dose-dependent reduction of human IRF4 mRNA by modified oligonucleotides

| Compound Number | IRF4 expression (% UTC) | | | | IC$_{50}$ (μM) |
|---|---|---|---|---|---|
| | 296 nM | 888 nM | 2,666 nM | 8,000 nM | |
| 609408 | 85 | 50 | 22 | 11 | 1.1 |
| 881411 | 101 | 70 | 45 | 22 | 2.3 |
| 881412 | 105 | 74 | 33 | 21 | 2.1 |
| 881460 | 71 | 50 | 26 | 17 | 0.9 |
| 881530 | 83 | 57 | 34 | 20 | 1.4 |
| 881577 | 89 | 71 | 39 | 20 | 1.9 |
| 881578 | 67 | 48 | 32 | 18 | 0.8 |
| 881597 | 83 | 69 | 49 | 30 | 2.4 |
| 881717 | 70 | 46 | 20 | 15 | 0.8 |
| 881718 | 91 | 62 | 31 | 20 | 1.6 |
| 881741 | 73 | 49 | 24 | 16 | 0.9 |
| 881742 | 64 | 42 | 22 | 14 | 0.6 |
| 881973 | 79 | 58 | 43 | 35 | 2.0 |
| 882352 | 112 | 59 | 36 | 16 | 1.9 |
| 882725 | 90 | 68 | 43 | 20 | 2.0 |
| 882749 | 94 | 83 | 49 | 23 | 2.7 |
| 882797 | 69 | 52 | 27 | 16 | 0.9 |
| 882819 | 97 | 82 | 61 | 28 | 3.5 |
| 882866 | 136 | 119 | 65 | 28 | 4.5 |

TABLE 74

Dose-dependent reduction of human IRF4 mRNA by modified oligonucleotides

| Compound Number | IRF4 expression (% UTC) | | | | IC$_{50}$ (μM) |
|---|---|---|---|---|---|
| | 296 nM | 888 nM | 2,666 nM | 8,000 nM | |
| 609408 | 96 | 45 | 25 | 15 | 1.3 |
| 881127 | 100 | 72 | 44 | 21 | 2.3 |
| 881317 | 74 | 48 | 33 | 18 | 1.0 |
| 881389 | 79 | 67 | 42 | 23 | 1.8 |
| 881413 | 59 | 43 | 35 | 20 | 0.6 |
| 881414 | 97 | 79 | 37 | 20 | 2.2 |
| 881437 | 91 | 67 | 36 | 21 | 1.8 |
| 881581 | 62 | 43 | 27 | 21 | 0.6 |
| 881671 | 80 | 66 | 47 | 41 | 3.1 |
| 881743 | 68 | 55 | 30 | 24 | 1.0 |
| 881791 | 81 | 61 | 34 | 13 | 1.3 |
| 882069 | 74 | 60 | 39 | 30 | 1.6 |
| 882070 | 81 | 60 | 42 | 33 | 2.0 |
| 882162 | 79 | 67 | 42 | 17 | 1.6 |
| 882185 | 73 | 50 | 24 | 22 | 1.0 |
| 882282 | 65 | 38 | 22 | 14 | 0.6 |
| 882305 | 62 | 43 | 15 | 19 | 0.5 |
| 882376 | 97 | 88 | 61 | 33 | 4.1 |
| 882377 | 82 | 46 | 22 | 13 | 1.0 |

TABLE 75

Dose-dependent reduction of human IRF4 mRNA by modified oligonucleotides

| Compound Number | IRF4 expression (% UTC) | | | | IC$_{50}$ (μM) |
|---|---|---|---|---|---|
| | 296 nM | 888 nM | 2,666 nM | 8,000 nM | |
| 609408 | 69 | 41 | 21 | 11 | 0.7 |
| 881391 | 100 | 67 | 36 | 21 | 2.0 |
| 881439 | 76 | 48 | 32 | 19 | 1.1 |
| 881511 | 82 | 73 | 36 | 26 | 2.0 |
| 881558 | 70 | 49 | 29 | 14 | 0.9 |
| 881582 | 61 | 42 | 21 | 15 | 0.5 |
| 881601 | 92 | 76 | 47 | 18 | 2.2 |
| 881648 | 78 | 68 | 36 | 21 | 1.6 |
| 881672 | 66 | 51 | 30 | 18 | 0.8 |
| 881744 | 95 | 78 | 43 | 19 | 2.2 |
| 881746 | 69 | 41 | 26 | 15 | 0.7 |
| 881975 | 101 | 91 | 63 | 51 | >8.0 |
| 881999 | 71 | 53 | 31 | 26 | 1.1 |
| 882210 | 91 | 78 | 50 | 22 | 2.5 |
| 882283 | 79 | 55 | 29 | 17 | 1.2 |
| 882354 | 81 | 57 | 34 | 20 | 1.4 |
| 882379 | 108 | 86 | 60 | 25 | 3.4 |
| 882800 | 77 | 55 | 28 | 15 | 1.1 |
| 882870 | 69 | 42 | 23 | 12 | 0.7 |

TABLE 76

Dose-dependent reduction of human IRF4 mRNA by modified oligonucleotides

| Compound Number | IRF4 expression (% UTC) | | | | IC$_{50}$ (μM) |
|---|---|---|---|---|---|
| | 296 nM | 888 nM | 2,666 nM | 8,000 nM | |
| 609408 | 81 | 47 | 29 | 18 | 1.1 |
| 881296 | 84 | 60 | 57 | 38 | 3.2 |
| 881440 | 75 | 74 | 46 | 26 | 2.2 |
| 881441 | 93 | 68 | 34 | 26 | 2.0 |
| 881465 | 85 | 63 | 38 | 29 | 1.9 |
| 881512 | 82 | 60 | 38 | 27 | 1.7 |
| 881559 | 84 | 62 | 47 | 31 | 2.2 |
| 881747 | 80 | 57 | 37 | 26 | 1.5 |
| 881955 | 73 | 66 | 35 | 30 | 1.6 |
| 882072 | 82 | 73 | 51 | 32 | 2.8 |
| 882142 | 85 | 68 | 48 | 31 | 2.5 |
| 882214 | 77 | 46 | 30 | 13 | 1.0 |
| 882309 | 74 | 54 | 51 | 24 | 1.6 |
| 882310 | 81 | 35 | 31 | 14 | 0.9 |
| 882357 | 74 | 58 | 35 | 31 | 1.5 |
| 882495 | 93 | 76 | 52 | 33 | 3.2 |
| 882565 | 90 | 77 | 55 | 33 | 3.3 |
| 882777 | 96 | 75 | 35 | 33 | 2.5 |
| 882871 | 67 | 49 | 44 | 21 | 1.1 |

TABLE 77

Dose-dependent reduction of human IRF4 mRNA by modified oligonucleotides

| Compound Number | IRF4 expression (% UTC) | | | | IC$_{50}$ (μM) |
|---|---|---|---|---|---|
| | 296 nM | 888 nM | 2,666 nM | 8,000 nM | |
| 609408 | 83 | 48 | 25 | 15 | 1.1 |
| 881322 | 98 | 71 | 42 | 17 | 2.0 |
| 881371 | 91 | 70 | 37 | 22 | 1.9 |
| 881394 | 77 | 47 | 27 | 14 | 1.0 |
| 881395 | 77 | 49 | 26 | 15 | 1.0 |
| 881442 | 51 | 36 | 22 | 9 | 0.3 |
| 881514 | 88 | 75 | 46 | 21 | 2.2 |
| 881561 | 92 | 62 | 38 | 18 | 1.7 |
| 881585 | 76 | 52 | 34 | 23 | 1.2 |
| 881724 | 100 | 72 | 39 | 22 | 2.2 |
| 881748 | 81 | 61 | 34 | 20 | 1.5 |
| 881749 | 70 | 46 | 27 | 12 | 0.8 |
| 881773 | 88 | 59 | 33 | 20 | 1.5 |
| 882215 | 83 | 60 | 50 | 26 | 2.0 |
| 882311 | 82 | 63 | 36 | 21 | 1.6 |
| 882358 | 80 | 52 | 32 | 17 | 1.2 |
| 882359 | 91 | 57 | 34 | 11 | 1.4 |
| 882383 | 92 | 86 | 64 | 37 | 4.8 |
| 882429 | 74 | 52 | 32 | 11 | 1.0 |

TABLE 78

Dose-dependent reduction of human IRF4 mRNA by modified oligonucleotides

| Compound Number | IRF4 expression (% UTC) | | | | IC$_{50}$ (μM) |
|---|---|---|---|---|---|
| | 296 nM | 888 nM | 2,666 nM | 8,000 nM | |
| 609408 | 85 | 53 | 36 | 14 | 1.3 |
| 881133 | 101 | 88 | 76 | 63 | >8.0 |
| 881204 | 92 | 79 | 50 | 26 | 2.7 |
| 881396 | 71 | 46 | 29 | 16 | 0.9 |
| 881515 | 90 | 67 | 44 | 21 | 2.0 |
| 881516 | 81 | 49 | 35 | 17 | 1.2 |
| 881588 | 69 | 52 | 26 | 18 | 0.9 |
| 881726 | 73 | 42 | 44 | 8 | 1.0 |
| 881727 | 66 | 50 | 35 | 19 | 0.9 |
| 881750 | 73 | 49 | 19 | 17 | 0.9 |
| 882077 | 93 | 78 | 54 | 37 | 3.7 |
| 882099 | 61 | 46 | 18 | 23 | 0.6 |
| 882169 | 101 | 84 | 51 | 18 | 2.6 |
| 882170 | 92 | 76 | 39 | 25 | 2.2 |
| 882313 | 87 | 60 | 32 | 18 | 1.5 |
| 882384 | 93 | 68 | 40 | 18 | 1.9 |
| 882408 | 84 | 61 | 41 | 19 | 1.6 |
| 882709 | 104 | 106 | 108 | 98 | >8.0 |
| 882758 | 82 | 53 | 36 | 17 | 1.3 |

TABLE 79

Dose-dependent reduction of human IRF4 mRNA by modified oligonucleotides

| Compound Number | IRF4 expression (% UTC) | | | | IC$_{50}$ (μM) |
|---|---|---|---|---|---|
| | 296 nM | 888 nM | 2,666 nM | 8,000 nM | |
| 609408 | 83 | 49 | 25 | 10 | 1.1 |
| 881279 | 87 | 73 | 43 | 22 | 2.1 |
| 881399 | 79 | 49 | 23 | 24 | 1.1 |
| 881422 | 85 | 63 | 44 | 29 | 2.1 |
| 881470 | 109 | 92 | 54 | 19 | 3.0 |
| 881494 | 68 | 50 | 33 | 20 | 0.9 |
| 881495 | 68 | 46 | 24 | 17 | 0.8 |
| 881517 | 75 | 41 | 14 | 12 | 0.7 |
| 881542 | 76 | 55 | 31 | 13 | 1.1 |
| 881589 | 80 | 48 | 26 | 10 | 1.0 |
| 881607 | 90 | 64 | 32 | 19 | 1.6 |
| 881608 | 73 | 45 | 22 | 21 | 0.8 |
| 881728 | 58 | 32 | 17 | 11 | 0.4 |
| 881729 | 94 | 75 | 40 | 29 | 2.4 |
| 881752 | 75 | 47 | 28 | 14 | 0.9 |
| 882409 | 86 | 66 | 42 | 20 | 1.8 |
| 882432 | 101 | 67 | 34 | 12 | 1.7 |
| 882433 | 72 | 38 | 25 | 16 | 0.7 |
| 882806 | 92 | 35 | 45 | 34 | 1.7 |

TABLE 80

Dose-dependent reduction of human IRF4 mRNA by modified oligonucleotides

| Compound Number | IRF4 expression (% UTC) | | | | IC$_{50}$ (μM) |
|---|---|---|---|---|---|
| | 296 nM | 888 nM | 2,666 nM | 8,000 nM | |
| 609408 | 99 | 55 | 43 | 12 | 1.7 |
| 690521 | 88 | 58 | 36 | 21 | 1.6 |
| 881112 | 133 | 107 | 73 | 56 | >8.0 |
| 881183 | 109 | 93 | 58 | 31 | 3.9 |
| 881280 | 94 | 61 | 40 | 23 | 1.9 |
| 881303 | 90 | 79 | 55 | 28 | 3.0 |
| 881304 | 94 | 86 | 86 | 37 | 7.9 |
| 881327 | 125 | 115 | 71 | 44 | 6.9 |
| 881448 | 82 | 58 | 36 | 21 | 1.5 |
| 881496 | 72 | 55 | 34 | 21 | 1.2 |
| 881543 | 86 | 67 | 37 | 24 | 1.8 |
| 881610 | 71 | 49 | 22 | 13 | 0.8 |
| 881657 | 83 | 61 | 46 | 29 | 2.0 |
| 881658 | 77 | 53 | 29 | 13 | 1.1 |
| 881753 | 81 | 70 | 48 | 20 | 2.0 |
| 881962 | 87 | 67 | 49 | 29 | 2.5 |
| 882268 | 110 | 72 | 50 | 31 | 3.0 |
| 882479 | 96 | 81 | 45 | 42 | 3.7 |
| 882761 | 76 | 67 | 37 | 25 | 1.6 |

TABLE 81

Dose-dependent reduction of human IRF4 mRNA by modified oligonucleotides

| Compound Number | IRF4 expression (% UTC) | | | | IC$_{50}$ (μM) |
|---|---|---|---|---|---|
| | 296 nM | 888 nM | 2,666 nM | 8,000 nM | |
| 609408 | 87 | 48 | 28 | 15 | 1.2 |
| 690522 | 63 | 32 | 13 | 11 | 0.4 |
| 690523 | 90 | 61 | 37 | 19 | 1.7 |
| 881281 | 95 | 69 | 49 | 32 | 2.8 |
| 881305 | 76 | 60 | 42 | 23 | 1.6 |
| 881425 | 71 | 53 | 34 | 21 | 1.1 |
| 881426 | 73 | 45 | 29 | 19 | 0.9 |
| 881449 | 65 | 50 | 28 | 16 | 0.8 |
| 881497 | 129 | 95 | 57 | 19 | 3.3 |
| 881498 | 98 | 71 | 34 | 16 | 1.9 |
| 881659 | 53 | 25 | 13 | 9 | <0.3 |
| 881660 | 65 | 32 | 17 | 10 | 0.5 |
| 881683 | 74 | 60 | 37 | 22 | 1.4 |
| 881780 | 82 | 54 | 34 | 17 | 1.3 |
| 881963 | 91 | 66 | 39 | 33 | 2.3 |
| 882175 | 79 | 43 | 24 | 12 | 0.9 |
| 882246 | 69 | 44 | 29 | 11 | 0.8 |
| 882810 | 100 | 66 | 45 | 25 | 2.3 |
| 882833 | 101 | 86 | 57 | 23 | 3.1 |

TABLE 82

Dose-dependent reduction of human IRF4 mRNA by modified oligonucleotides

| Compound Number | IRF4 expression (% UTC) | | | | IC$_{50}$ (µM) |
|---|---|---|---|---|---|
| | 296 nM | 888 nM | 2,666 nM | 8,000 nM | |
| 609408 | 87 | 51 | 28 | 14 | 1.2 |
| 881258 | 115 | 91 | 60 | 31 | 3.9 |
| 881282 | 104 | 89 | 42 | 32 | 3.1 |
| 881404 | 89 | 81 | 43 | 27 | 2.5 |
| 881427 | 87 | 65 | 48 | 19 | 1.9 |
| 881450 | 63 | 42 | 26 | 12 | 0.6 |
| 881451 | 100 | 77 | 49 | 30 | 2.9 |
| 881452 | 77 | 67 | 49 | 27 | 2.2 |
| 881499 | 84 | 74 | 44 | 35 | 2.7 |
| 881661 | 122 | 92 | 51 | 23 | 3.2 |
| 881684 | 106 | 89 | 55 | 33 | 3.8 |
| 881733 | 82 | 63 | 32 | 29 | 1.7 |
| 881734 | 72 | 49 | 34 | 23 | 1.0 |
| 881941 | 94 | 86 | 60 | 41 | 5.2 |
| 882177 | 94 | 62 | 35 | 30 | 2.0 |
| 882199 | 90 | 81 | 38 | 16 | 2.0 |
| 882200 | 89 | 60 | 36 | 22 | 1.7 |
| 882247 | 79 | 60 | 47 | 33 | 2.2 |
| 882765 | 101 | 82 | 57 | 30 | 3.5 |

TABLE 83

Dose-dependent reduction of human IRF4 mRNA by modified oligonucleotides

| Compound Number | IRF4 expression (% UTC) | | | | IC$_{50}$ (µM) |
|---|---|---|---|---|---|
| | 296 nM | 888 nM | 2,666 nM | 8,000 nM | |
| 609408 | 87 | 49 | 30 | 11 | 1.2 |
| 881213 | 85 | 67 | 50 | 20 | 2.1 |
| 881238 | 83 | 58 | 33 | 19 | 1.4 |
| 881286 | 64 | 51 | 35 | 22 | 0.9 |
| 881381 | 77 | 55 | 34 | 26 | 1.3 |
| 881382 | 83 | 71 | 49 | 37 | 3.0 |
| 881405 | 86 | 58 | 42 | 16 | 1.6 |
| 881477 | 80 | 62 | 56 | 28 | 2.4 |
| 881478 | 102 | 69 | 47 | 30 | 2.7 |
| 881571 | 109 | 90 | 47 | 27 | 3.1 |
| 881572 | 87 | 67 | 39 | 25 | 1.9 |
| 881616 | 104 | 76 | 47 | 36 | 3.3 |
| 881663 | 130 | 108 | 63 | 32 | 4.6 |
| 881784 | 117 | 87 | 50 | 35 | 3.7 |
| 882085 | 82 | 66 | 46 | 27 | 2.1 |
| 882107 | 109 | 83 | 74 | 37 | 5.5 |
| 882178 | 114 | 69 | 36 | 16 | 2.1 |
| 882601 | 123 | 99 | 64 | 26 | 4.0 |
| 882670 | 91 | 85 | 66 | 34 | 4.7 |

TABLE 84

Dose-dependent reduction of human IRF4 mRNA by modified oligonucleotides

| Compound Number | IRF4 expression (% UTC) | | | | IC$_{50}$ (µM) |
|---|---|---|---|---|---|
| | 296 nM | 888 nM | 2,666 nM | 8,000 nM | |
| 609408 | 101 | 60 | 32 | 14 | 1.6 |
| 881240 | 103 | 79 | 47 | 23 | 2.6 |
| 881359 | 124 | 89 | 57 | 35 | 4.1 |
| 881360 | 83 | 58 | 40 | 22 | 1.6 |
| 881384 | 85 | 72 | 42 | 39 | 2.8 |
| 881432 | 73 | 62 | 49 | 29 | 2.0 |
| 881575 | 92 | 67 | 52 | 40 | 3.4 |
| 881593 | 84 | 71 | 57 | 31 | 3.1 |
| 881761 | 94 | 93 | 72 | 56 | >8.0 |
| 882039 | 95 | 79 | 68 | 50 | >8.0 |

TABLE 84-continued

Dose-dependent reduction of human IRF4 mRNA by modified oligonucleotides

| Compound Number | IRF4 expression (% UTC) | | | | IC$_{50}$ (µM) |
|---|---|---|---|---|---|
| | 296 nM | 888 nM | 2,666 nM | 8,000 nM | |
| 882086 | 96 | 79 | 50 | 25 | 2.7 |
| 882087 | 72 | 55 | 36 | 32 | 1.4 |
| 882204 | 67 | 77 | 38 | 30 | 1.9 |
| 882227 | 111 | 90 | 54 | 47 | 5.2 |
| 882228 | 96 | 75 | 52 | 40 | 3.8 |
| 882323 | 106 | 87 | 62 | 34 | 4.3 |
| 882532 | 114 | 85 | 54 | 33 | 3.7 |
| 882721 | 98 | 78 | 69 | 45 | 6.6 |
| 882744 | 84 | 79 | 50 | 31 | 2.9 |

Example 15: Effect of Modified Oligonucleotides on Human IRF4 In Vitro, Multiple Doses Modified oligonucleotides selected from the examples above were tested at various doses in MM.1R cells. Cells were plated at a density of 5,000 cells per well and transfected by free uptake with 74 nM, 222 nM, 666 nM, and 2,000 nM concentrations of modified oligonucleotide, as specified in the tables below. After a treatment period of approximately 24 hours, RNA was isolated from the cells and IRF4 mRNA levels were measured by RT-qPCR. Human IRF4 primer probe set hIRF4_LTS34726 (described hereinabove in Example 7) was used to measure mRNA levels. IRF4 mRNA levels were adjusted according to total RNA content, as measured by RiboGreen. Results are presented as the percent level of IRF4 mRNA transcript, relative to that of untreated control (UTC) cells. As illustrated in the tables below, IRF4 mRNA levels were reduced in a dose-dependent manner in cells treated with modified oligonucleotides.

TABLE 85

Dose-dependent reduction of human IRF4 mRNA by modified oligonucleotides

| Compound Number | IRF4 expression (% UTC) | | | | IC$_{50}$ (µM) |
|---|---|---|---|---|---|
| | 74 nM | 222 nM | 666 nM | 2,000 nM | |
| 609408 | 86 | 66 | 43 | 17 | 0.4 |
| 935580 | 89 | 62 | 34 | 10 | 0.4 |
| 935603 | 91 | 69 | 46 | 23 | 0.5 |
| 935620 | 84 | 64 | 37 | 15 | 0.4 |
| 935658 | 82 | 56 | 37 | 15 | 0.3 |
| 935898 | 74 | 47 | 24 | 7 | 0.2 |
| 935911 | 100 | 88 | 66 | 43 | 1.5 |
| 935918 | 90 | 75 | 45 | 23 | 0.6 |
| 935921 | 80 | 52 | 27 | 9 | 0.3 |
| 935925 | 98 | 67 | 62 | 36 | 0.9 |
| 935928 | 90 | 72 | 48 | 23 | 0.6 |
| 935929 | 96 | 85 | 60 | 36 | 1.1 |
| 935935 | 95 | 83 | 63 | 32 | 1.0 |
| 935939 | 86 | 74 | 50 | 41 | 0.9 |
| 935941 | 86 | 84 | 70 | 41 | 1.7 |
| 935948 | 86 | 62 | 45 | 24 | 0.5 |
| 935958 | 83 | 56 | 33 | 14 | 0.3 |
| 935961 | 78 | 51 | 27 | 8 | 0.3 |
| 935968 | 88 | 61 | 35 | 12 | 0.4 |

TABLE 86

Dose-dependent reduction of human IRF4 mRNA by modified oligonucleotides

| Compound Number | IRF4 expression (% UTC) | | | | IC$_{50}$ (µM) |
|---|---|---|---|---|---|
| | 74 nM | 222 nM | 666 nM | 2,000 nM | |
| 609408 | 79 | 59 | 37 | 14 | 0.3 |
| 935581 | 78 | 61 | 38 | 15 | 0.4 |
| 935608 | 85 | 71 | 48 | 20 | 0.5 |
| 935655 | 93 | 88 | 70 | 46 | >2.0 |
| 935679 | 92 | 72 | 47 | 23 | 0.6 |
| 935689 | 86 | 63 | 40 | 19 | 0.4 |
| 935696 | 72 | 45 | 22 | 9 | 0.2 |
| 935697 | 80 | 55 | 23 | 9 | 0.3 |
| 935698 | 83 | 68 | 39 | 17 | 0.4 |
| 935699 | 87 | 60 | 36 | 14 | 0.4 |
| 935700 | 72 | 59 | 26 | 7 | 0.3 |
| 935701 | 82 | 64 | 40 | 18 | 0.4 |
| 935707 | 84 | 68 | 49 | 23 | 0.5 |
| 935708 | 84 | 59 | 34 | 15 | 0.4 |
| 935721 | 86 | 70 | 46 | 24 | 0.5 |
| 935724 | 73 | 39 | 20 | 5 | 0.2 |
| 935727 | 85 | 67 | 49 | 27 | 0.6 |
| 935734 | 74 | 58 | 35 | 16 | 0.3 |
| 935741 | 85 | 68 | 42 | 17 | 0.4 |

TABLE 87

Dose-dependent reduction of human IRF4 mRNA by modified oligonucleotides

| Compound Number | IRF4 expression (% UTC) | | | | IC$_{50}$ (µM) |
|---|---|---|---|---|---|
| | 74 nM | 222 nM | 666 nM | 2,000 nM | |
| 609408 | 77 | 60 | 41 | 16 | 0.4 |
| 935668 | 94 | 78 | 51 | 25 | 0.7 |
| 935671 | 91 | 73 | 54 | 27 | 0.7 |
| 935686 | 90 | 69 | 53 | 34 | 0.8 |
| 935709 | 72 | 78 | 57 | 36 | 0.9 |
| 935731 | 80 | 66 | 52 | 36 | 0.7 |
| 935762 | 72 | 56 | 35 | 19 | 0.3 |
| 935765 | 75 | 55 | 37 | 15 | 0.3 |
| 935772 | 81 | 65 | 51 | 27 | 0.6 |
| 935779 | 78 | 72 | 55 | 28 | 0.7 |
| 935782 | 66 | 55 | 36 | 15 | 0.2 |
| 935789 | 81 | 77 | 58 | 32 | 0.9 |
| 935795 | 95 | 77 | 60 | 33 | 0.9 |
| 935805 | 85 | 68 | 42 | 21 | 0.5 |
| 935850 | 74 | 48 | 25 | 12 | 0.2 |
| 935851 | 78 | 54 | 26 | 9 | 0.3 |
| 935854 | 79 | 64 | 35 | 14 | 0.3 |
| 935857 | 78 | 66 | 44 | 19 | 0.4 |
| 935878 | 71 | 42 | 24 | 10 | 0.2 |

TABLE 88

Dose-dependent reduction of human IRF4 mRNA by modified oligonucleotides

| Compound Number | IRF4 expression (% UTC) | | | | IC$_{50}$ (µM) |
|---|---|---|---|---|---|
| | 74 nM | 222 nM | 666 nM | 2,000 nM | |
| 609408 | 79 | 62 | 39 | 15 | 0.4 |
| 881450 | 100 | 75 | 56 | 28 | 0.8 |
| 881659 | 76 | 45 | 21 | 5 | 0.2 |
| 935824 | 86 | 65 | 46 | 23 | 0.5 |
| 935833 | 81 | 60 | 44 | 26 | 0.5 |
| 935840 | 82 | 54 | 51 | 27 | 0.5 |
| 935853 | 85 | 64 | 45 | 21 | 0.5 |
| 935856 | 92 | 71 | 50 | 29 | 0.7 |
| 935859 | 90 | 81 | 63 | 36 | 1.1 |
| 935888 | 79 | 72 | 43 | 20 | 0.5 |
| 936006 | 80 | 64 | 41 | 21 | 0.4 |
| 936007 | 87 | 65 | 34 | 13 | 0.4 |
| 936011 | 94 | 79 | 62 | 40 | 1.2 |
| 936013 | 78 | 67 | 48 | 26 | 0.5 |
| 936016 | 83 | 62 | 43 | 21 | 0.4 |
| 936018 | 82 | 66 | 43 | 17 | 0.4 |
| 936033 | 80 | 63 | 47 | 25 | 0.5 |
| 936039 | 85 | 67 | 48 | 25 | 0.5 |
| 936046 | 88 | 66 | 49 | 30 | 0.6 |

Example 16: Effect of Modified Oligonucleotides on Human IRF4 In Vitro, Multiple Doses Modified oligonucleotides selected from the examples above were tested at various doses in MM.1R cells. Cells were plated at a density of 5,000 cells per well and transfected by free uptake with 74 nM, 222 nM, 666 nM, and 2,000 nM concentrations of modified oligonucleotide, as specified in the tables below. After a treatment period of approximately 24 hours, RNA was isolated from the cells and IRF4 mRNA levels were measured by RT-qPCR. Human IRF4 primer probe set hIRF4_LTS34726 (described hereinabove in Example 7) was used to measure mRNA levels. IRF4 mRNA levels were adjusted according to total RNA content, as measured by RiboGreen. Results are presented as the percent level of IRF4 mRNA transcript, relative to that of untreated control (UTC) cells. As illustrated in the tables below, IRF4 mRNA levels were reduced in a dose-dependent manner in cells treated with modified oligonucleotides.

TABLE 89

Dose-dependent reduction of human IRF4 mRNA by modified oligonucleotides

| Compound Number | IRF4 expression (% UTC) | | | |
|---|---|---|---|---|
| | 74 nM | 222 nM | 666 nM | 2,000 nM |
| 609311 | 94 | 106 | 100 | 87 |
| 609312 | 97 | 96 | 103 | 93 |
| 609328 | 87 | 86 | 88 | 83 |
| 609337 | 94 | 98 | 99 | 96 |
| 609354 | 93 | 88 | 76 | 50 |
| 609357 | 101 | 87 | 90 | 61 |
| 609408 | 83 | 57 | 35 | 11 |
| 609422 | 96 | 100 | 90 | 76 |
| 609530 | 103 | 94 | 94 | 87 |
| 609533 | 103 | 103 | 91 | 75 |
| 609546 | 100 | 103 | 107 | 97 |
| 609591 | 93 | 94 | 89 | 68 |
| 609592 | 95 | 94 | 88 | 76 |

TABLE 90

Dose-dependent reduction of human IRF4 mRNA by modified oligonucleotides

| Compound Number | IRF4 expression (% UTC) | | | |
|---|---|---|---|---|
| | 74 nM | 222 nM | 666 nM | 2,000 nM |
| 609408 | 93 | 61 | 37 | 12 |
| 609592 | 97 | 85 | 88 | 81 |

TABLE 90-continued

Dose-dependent reduction of human IRF4 mRNA by modified oligonucleotides

| Compound Number | IRF4 expression (% UTC) | | | |
|---|---|---|---|---|
| | 74 nM | 222 nM | 666 nM | 2,000 nM |
| 609594 | 98 | 97 | 81 | 85 |
| 881127 | 96 | 98 | 87 | 66 |
| 881183 | 93 | 89 | 75 | 55 |
| 881193 | 25 | 21 | 17 | 13 |
| 881204 | 97 | 82 | 49 | 26 |
| 881955 | 97 | 73 | 44 | 16 |
| 881962 | 119 | 96 | 93 | 67 |
| 881963 | 104 | 119 | 104 | 91 |
| 881973 | 99 | 95 | 89 | 74 |
| 881999 | 98 | 91 | 80 | 46 |
| 882066 | 108 | 103 | 104 | 94 |
| 882069 | 109 | 99 | 91 | 65 |
| 882070 | 108 | 106 | 81 | 68 |
| 882072 | 112 | 104 | 94 | 72 |
| 882077 | 107 | 122 | 101 | 102 |
| 882085 | 96 | 85 | 71 | 37 |
| 882086 | 90 | 77 | 50 | 17 |

TABLE 91

Dose-dependent reduction of human IRF4 mRNA by modified oligonucleotides

| Compound Number | IRF4 expression (% UTC) | | | |
|---|---|---|---|---|
| | 74 nM | 222 nM | 666 nM | 2,000 nM |
| 609408 | 84 | 68 | 36 | 12 |
| 882087 | 84 | 75 | 52 | 23 |
| 882142 | 95 | 99 | 82 | 68 |
| 882162 | 87 | 94 | 76 | 49 |
| 882169 | 97 | 79 | 59 | 41 |
| 882170 | 86 | 77 | 60 | 28 |
| 882175 | 98 | 101 | 72 | 46 |
| 882177 | 94 | 96 | 80 | 60 |
| 882178 | 103 | 105 | 109 | 95 |
| 882185 | 100 | 95 | 87 | 63 |
| 882199 | 98 | 105 | 98 | 85 |
| 882200 | 111 | 118 | 101 | 87 |
| 882204 | 101 | 96 | 78 | 61 |
| 882214 | 113 | 106 | 96 | 80 |
| 882215 | 112 | 113 | 110 | 104 |
| 882227 | 114 | 100 | 109 | 90 |
| 882228 | 101 | 92 | 85 | 63 |
| 882247 | 114 | 105 | 104 | 102 |
| 882268 | 108 | 94 | 89 | 67 |

TABLE 92

Dose-dependent reduction of human IRF4 mRNA by modified oligonucleotides

| Compound Number | IRF4 expression (% UTC) | | | |
|---|---|---|---|---|
| | 74 nM | 222 nM | 666 nM | 2,000 nM |
| 609408 | 81 | 69 | 39 | 9 |
| 882283 | 98 | 94 | 86 | 54 |
| 882309 | 85 | 93 | 79 | 49 |
| 882310 | 91 | 94 | 85 | 92 |
| 882311 | 83 | 74 | 59 | 18 |
| 882313 | 87 | 73 | 57 | 25 |

TABLE 92-continued

Dose-dependent reduction of human IRF4 mRNA by modified oligonucleotides

| Compound Number | IRF4 expression (% UTC) | | | |
|---|---|---|---|---|
| | 74 nM | 222 nM | 666 nM | 2,000 nM |
| 882323 | 92 | 95 | 81 | 50 |
| 882325 | 99 | 87 | 62 | 31 |
| 882326 | 100 | 98 | 100 | 68 |
| 882352 | 93 | 91 | 78 | 62 |
| 882354 | 96 | 93 | 78 | 66 |
| 882357 | 103 | 84 | 78 | 48 |
| 882358 | 90 | 74 | 42 | 13 |
| 882359 | 109 | 112 | 104 | 91 |
| 882376 | 104 | 107 | 97 | 86 |
| 882377 | 98 | 94 | 89 | 64 |
| 882379 | 101 | 101 | 108 | 101 |
| 882383 | 106 | 112 | 104 | 104 |
| 882384 | 101 | 98 | 80 | 62 |

TABLE 93

Dose-dependent reduction of human IRF4 mRNA by modified oligonucleotides

| Compound Number | IRF4 expression (% UTC) | | | |
|---|---|---|---|---|
| | 74 nM | 222 nM | 666 nM | 2,000 nM |
| 609408 | 74 | 64 | 38 | 13 |
| 882398 | 81 | 74 | 63 | 28 |
| 882408 | 88 | 77 | 64 | 37 |
| 882409 | 101 | 67 | 89 | 92 |
| 882429 | 98 | 90 | 90 | 89 |
| 882432 | 88 | 93 | 91 | 83 |
| 882479 | 86 | 91 | 89 | 56 |
| 882495 | 83 | 100 | 96 | 87 |
| 882532 | 89 | 101 | 126 | N/A |
| 882565 | 107 | 109 | 109 | 92 |
| 882601 | 103 | 98 | 85 | 91 |
| 882670 | 104 | 95 | 91 | 60 |
| 882721 | 98 | 97 | 91 | 73 |
| 882725 | 93 | 92 | 80 | 72 |
| 882744 | 100 | 66 | 73 | 48 |
| 882749 | 89 | 92 | 77 | 55 |
| 882758 | 88 | 79 | 72 | 56 |
| 882761 | 87 | 88 | 77 | 61 |
| 882765 | 89 | 103 | 94 | 98 |

TABLE 94

Dose-dependent reduction of human IRF4 mRNA by modified oligonucleotides

| Compound Number | IRF4 expression (% UTC) | | | |
|---|---|---|---|---|
| | 74 nM | 222 nM | 666 nM | 2,000 nM |
| 609408 | 54 | 34 | 41 | N/A |
| 881450 | 65 | 59 | 29 | 11 |
| 881659 | 45 | 19 | 6 | 2 |
| 882777 | 109 | 133 | 93 | 105 |
| 882797 | 113 | 106 | 93 | 63 |
| 882800 | 112 | 83 | 56 | 22 |
| 882806 | 100 | 115 | 107 | 91 |
| 882810 | 88 | 88 | 84 | 50 |

Example 17: Design of 3-10-3 cEt Gapmers with Phosphorothioate Internucleoside Linkages Modified oligonucleotides complementary to a human IRF4 nucleic acid were designed. The modified oligonucleotides in Table 95 are 3-10-3 cEt gapmers. The gapmers are 16 nucleobases in length, wherein the central gap segment comprises ten 2'-deoxynucleosides and is flanked by wing segments on both the 5' end and on the 3' end comprising three cEt nucleosides. The sugar motif for the gapmers is (from 5' to 3'): kkkddddddddddkkk; wherein 'd' represents a 2'-deoxyribose sugar and 'k' represents a cEt modified sugar. Each internucleoside linkage is a phosphorothioate internucleoside linkage and each cytosine residue is a 5-methylcytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Table 95 below is complementary to human IRF4 nucleic acid sequences SEQ ID NO: 1 or SEQ ID NO: 2, as indicated. 'N/A' indicates that the modified oligonucleotide is not complementary to that particular nucleic acid sequence with 100% complementarity.

Example 18: Effect of Modified Oligonucleotides on Human IRF4 In Vitro, Multiple Doses Modified oligonucleotides selected from the examples above were tested at various doses in MM.1R cells. Cells were plated at a density of 5,000 cells per well and transfected by free uptake with 62.5 nM, 250 nM, 1,000 nM, and 4,000 nM concentrations of modified oligonucleotide, as specified in the tables below. After a treatment period of approximately 24 hours, RNA was isolated from the cells and IRF4 mRNA levels were measured by RT-qPCR. Human IRF4 primer probe set hIRF4_LTS34726 (described hereinabove in Example 7) was used to measure mRNA levels. IRF4 mRNA levels were adjusted according to total RNA content, as measured by RiboGreen. Results are presented as the percent level of IRF4 mRNA transcript, relative to that of untreated control (UTC) cells. As illustrated in the tables below, IRF4 mRNA levels were reduced in a dose-dependent manner in cells treated with modified oligonucleotides.

TABLE 95

Dose-dependent reduction of human IRF4 mRNA by modified oligonucleotides

| Compound Number | SEQ ID NO: 1 Start Site | SEQ ID NO: 1 Stop Site | SEQ ID NO: 2 Start Site | SEQ ID NO: 2 Stop Site | Sequence | SEQ ID NO |
|---|---|---|---|---|---|---|
| 970454 | N/A | N/A | 17700 | 17715 | AGAACATTACGAGAGG | 3371 |
| 970466 | N/A | N/A | 18074 | 18089 | GGTTGGCTGGTCTTTG | 3337 |
| 970500 | N/A | N/A | 18088 | 18103 | ATTATATACTGGTTGG | 3340 |
| 970524 | N/A | N/A | 18248 | 18263 | CGATCATCAACTTCTT | 3372 |
| 970527 | N/A | N/A | 18572 | 18587 | GTGATAGCTGAGCTGA | 3343 |
| 970539 | N/A | N/A | 18583 | 18598 | ACTGGATTGATGTGAT | 3373 |
| 970545 | N/A | N/A | 18718 | 18733 | GGAACTCATAGGTGTA | 3374 |
| 970546 | 1415 | 1430 | 19532 | 19547 | CTGATGTGTTCTGGTA | 3375 |
| 970547 | N/A | N/A | 17235 | 17250 | TACGCTTATTTTTCCA | 3376 |
| 970548 | N/A | N/A | 17474 | 17489 | GCAATCTTAACCTGGA | 3377 |
| 970552 | N/A | N/A | 18580 | 18595 | GGATTGATGTGATAGC | 3378 |
| 970554 | N/A | N/A | 19020 | 19035 | TCTGTATAGTTCTCAA | 3379 |
| 970574 | 1350 | 1365 | 19467 | 19482 | TAGTTGTCTGGCTAGC | 3380 |
| 970597 | N/A | N/A | 18575 | 18590 | GATGTGATAGCTGAGC | 3346 |
| 970598 | N/A | N/A | 18612 | 18627 | CAGTGACTTGCATCCA | 3350 |
| 970600 | 1346 | 1361 | 19463 | 19478 | TGTCTGGCTAGCAGAG | 3381 |
| 970602 | 1396 | 1411 | 19513 | 19528 | CGTAGCCCCTCAGGAA | 3382 |
| 970603 | 1423 | 1438 | 19540 | 19555 | CTGGATTGCTGATGTG | 3383 |

TABLE 96

Dose-dependent reduction of human IRF4 mRNA by modified oligonucleotides

| Compound Number | IRF4 expression (% UTC) | | | |
|---|---|---|---|---|
| | 62.5 nM | 250 nM | 1,000 nM | 4,000 nM |
| 609408 | 84 | 55 | 28 | 7 |
| 935583 | 99 | 77 | 32 | 8 |
| 969936 | 86 | 88 | 61 | 34 |
| 969937 | 94 | 100 | 75 | 33 |
| 969938 | 104 | 84 | 60 | 30 |
| 970044 | 115 | 107 | 79 | 42 |
| 970069 | 86 | 111 | 97 | 67 |
| 970104 | 101 | 87 | 60 | 30 |
| 970114 | 109 | 96 | 73 | 45 |
| 970117 | 109 | 84 | 48 | 19 |
| 970139 | 78 | 60 | 44 | 24 |
| 970158 | 101 | 102 | 81 | 46 |
| 970159 | 82 | 64 | 45 | 18 |
| 970189 | 85 | 66 | 42 | 25 |
| 970217 | 96 | 90 | 71 | 44 |
| 970228 | 65 | 77 | 37 | 13 |
| 970253 | 111 | 105 | 100 | 63 |
| 970344 | 83 | 117 | 124 | 92 |
| 970388 | 100 | 87 | 70 | 29 |

TABLE 97

Dose-dependent reduction of human IRF4 mRNA by modified oligonucleotides

| Compound Number | IRF4 expression (% UTC) | | | |
|---|---|---|---|---|
| | 62.5 nM | 250 nM | 1,000 nM | 4,000 nM |
| 609408 | 92 | 55 | 28 | 8 |
| 969879 | 106 | 110 | 107 | 113 |
| 969933 | 94 | 71 | 48 | 36 |
| 969991 | 115 | 92 | 56 | 13 |
| 970013 | 96 | 78 | 48 | 19 |
| 970043 | 102 | 82 | 43 | 16 |
| 970103 | 96 | 64 | 52 | 34 |
| 970160 | 111 | 96 | 75 | 35 |
| 970161 | 106 | 104 | 82 | 62 |
| 970162 | 94 | 82 | 60 | 18 |
| 970211 | 93 | 79 | 59 | 32 |
| 970212 | 97 | 80 | 38 | 7 |
| 970230 | 110 | 105 | 84 | 52 |
| 970231 | 113 | 105 | 114 | 94 |
| 970249 | 116 | 93 | 59 | 22 |
| 970358 | 113 | 110 | 87 | 55 |
| 970370 | 107 | 93 | 77 | 32 |
| 970382 | 113 | 97 | 70 | 40 |
| 970610 | 125 | 103 | 88 | 50 |

TABLE 98

Dose-dependent reduction of human IRF4 mRNA by modified oligonucleotides

| Compound Number | IRF4 expression (% UTC) | | | |
|---|---|---|---|---|
| | 62.5 nM | 250 nM | 1,000 nM | 4,000 nM |
| 609408 | 84 | 56 | 30 | 7 |
| 970454 | 98 | 84 | 59 | 35 |
| 970466 | 102 | 84 | 51 | 34 |
| 970500 | 97 | 85 | 61 | 23 |
| 970524 | 76 | 50 | 28 | 8 |
| 970527 | 87 | 62 | 30 | 11 |
| 970539 | 98 | 94 | 75 | 35 |
| 970545 | 89 | 74 | 47 | 25 |
| 970546 | 86 | 73 | 55 | 31 |
| 970547 | 99 | 71 | 49 | 35 |

TABLE 98-continued

Dose-dependent reduction of human IRF4 mRNA by modified oligonucleotides

| Compound Number | IRF4 expression (% UTC) | | | |
|---|---|---|---|---|
| | 62.5 nM | 250 nM | 1,000 nM | 4,000 nM |
| 970548 | 103 | 92 | 63 | 30 |
| 970552 | 93 | 76 | 41 | 12 |
| 970554 | 102 | 84 | 58 | 31 |
| 970574 | 96 | 84 | 68 | 32 |
| 970597 | 38 | 21 | 15 | 8 |
| 970598 | 60 | 57 | 47 | 25 |
| 970600 | 49 | 35 | 29 | 21 |
| 970602 | 41 | 39 | 32 | 19 |
| 970603 | 55 | 47 | 44 | 17 |

Example 19: Effect of Modified Oligonucleotides on Human IRF4 In Vitro, Multiple Doses Modified oligonucleotides selected from the examples above were tested at various doses in MM.1R cells. Cells were plated at a density of 5,000 cells per well and transfected by free uptake with 62.5 nM, 250 nM, 1,000 nM, and 4,000 nM concentrations of modified oligonucleotide, as specified in the tables below. After a treatment period of approximately 24 hours, RNA was isolated from the cells and IRF4 mRNA levels were measured by RT-qPCR. Human IRF4 primer probe set RTS4523 (forward sequence AAGCCTTGGCGTTCTCAGACT, designated herein as SEQ ID NO: 3386; reverse sequence TCAGCTCCTTCACGAGGATTTC, designated herein as SEQ ID NO: 3387; probe sequence CCGGCTGCACATCTGCCTGTACTACC, designated herein as SEQ ID: 3388), was used to measure mRNA levels. IRF4 mRNA levels were adjusted according to total RNA content, as measured by RiboGreen. Results are presented as the percent level of IRF4 mRNA transcript, relative to that of untreated control (UTC) cells. As illustrated in the table below, IRF4 mRNA levels were reduced in a dose-dependent manner in cells treated with modified oligonucleotides.

TABLE 99

Dose-dependent reduction of human IRF4 mRNA by modified oligonucleotides

| Compound Number | IRF4 expression (% UTC) | | | |
|---|---|---|---|---|
| | 62.5 nM | 250 nM | 1,000 nM | 4,000 nM |
| 609408 | 75 | 51 | 31 | 10 |
| 970454 | 88 | 80 | 49 | 34 |
| 970466 | 85 | 80 | 65 | 30 |
| 970500 | 91 | 75 | 43 | 26 |
| 970524 | 77 | 50 | 25 | 7 |
| 970527 | 83 | 53 | 25 | 12 |
| 970539 | 91 | 80 | 61 | 31 |
| 970545 | 68 | 58 | 35 | 20 |
| 970546 | 64 | 59 | 47 | 30 |
| 970547 | 88 | 56 | 44 | 23 |
| 970548 | 97 | 92 | 62 | 29 |
| 970552 | 76 | 80 | 40 | 12 |
| 970554 | 100 | 74 | 60 | 29 |
| 970574 | 93 | 76 | 67 | 32 |
| 970597 | 93 | 99 | 78 | 51 |
| 970598 | 80 | 76 | 62 | 39 |
| 970600 | 82 | 87 | 80 | 63 |
| 970602 | 85 | 80 | 66 | 41 |
| 970603 | 83 | 77 | 64 | 29 |

Example 20: Effect of Modified Oligonucleotides on Human IRF4 In Vitro, Multiple Doses Modified oligonucleotides selected from the examples above were tested at various doses in MM.1R cells. Cells were plated at a density of 5,000 cells per well and transfected by free uptake with 62.5 nM, 250 nM, 1,000 nM, and 4,000 nM concentrations of modified oligonucleotide, as specified in the tables below. After a treatment period of approximately 24 hours, RNA was isolated from the cells and IRF4 mRNA levels were measured by RT-qPCR. Human IRF4 primer probe set hIRF4_LTS34726 (described hereinabove in Example 7) was used to measure mRNA levels. IRF4 mRNA levels were adjusted according to total RNA content, as measured by RiboGreen. Results are presented as the percent level of IRF4 mRNA transcript, relative to that of untreated control (UTC) cells. As illustrated in the tables below, IRF4 mRNA levels were reduced in a dose-dependent manner in cells treated with modified oligonucleotides.

TABLE 100

Dose-dependent reduction of human IRF4 mRNA by modified oligonucleotides

| Compound Number | IRF4 expression (% UTC) | | | |
|---|---|---|---|---|
| | 62.5 nM | 250 nM | 1,000 nM | 4,000 nM |
| 609408 | 72 | 43 | 19 | 4 |
| 881955 | 89 | 69 | 40 | 10 |
| 881962 | 107 | 92 | 66 | 23 |
| 881963 | 116 | 116 | 99 | 88 |
| 881973 | 109 | 101 | 86 | 59 |
| 881999 | 117 | 98 | 72 | 32 |
| 882066 | 110 | 114 | 107 | 105 |
| 882069 | 100 | 95 | 75 | 43 |
| 882070 | 101 | 94 | 82 | 42 |
| 882072 | 95 | 98 | 83 | 59 |
| 882077 | 101 | 96 | 90 | 68 |
| 882085 | 96 | 71 | 49 | 13 |
| 882086 | 92 | 68 | 37 | 8 |
| 882087 | 98 | 74 | 45 | 13 |
| 882142 | 103 | 89 | 80 | 56 |
| 882162 | 94 | 80 | 61 | 27 |
| 882169 | 102 | 93 | 93 | 77 |
| 882170 | 99 | 84 | 71 | 35 |
| 882175 | 89 | 75 | 45 | 21 |

TABLE 101

Dose-dependent reduction of human IRF4 mRNA by modified oligonucleotides

| Compound Number | IRF4 expression (% UTC) | | | |
|---|---|---|---|---|
| | 62.5 nM | 250 nM | 1,000 nM | 4,000 nM |
| 609408 | 73 | 43 | 19 | 4 |
| 882177 | 83 | 66 | 38 | 11 |
| 882178 | 101 | 100 | 87 | 59 |
| 882185 | 99 | 90 | 73 | 41 |
| 882199 | 108 | 111 | 96 | 82 |
| 882200 | 112 | 106 | 97 | 66 |
| 882204 | 96 | 82 | 55 | 22 |
| 882214 | 98 | 92 | 53 | 12 |
| 882215 | 118 | 112 | 117 | 106 |
| 882228 | 89 | 75 | 46 | 15 |
| 882246 | 101 | 98 | 85 | 58 |
| 882247 | 97 | 101 | 92 | 74 |
| 882268 | 101 | 88 | 78 | 49 |
| 882283 | 104 | 95 | 86 | 48 |
| 882309 | 87 | 76 | 59 | 31 |
| 882310 | 96 | 103 | 105 | 107 |
| 882311 | 99 | 99 | 119 | 99 |
| 882313 | 98 | 82 | 61 | 31 |
| 882323 | 89 | 89 | 81 | 68 |

TABLE 102

Dose-dependent reduction of human IRF4 mRNA by modified oligonucleotides

| Compound Number | IRF4 expression (% UTC) | | | |
|---|---|---|---|---|
| | 62.5 nM | 250 nM | 1,000 nM | 4,000 nM |
| 609408 | 74 | 49 | 23 | 5 |
| 882325 | 94 | 95 | 85 | 45 |
| 882326 | 101 | 98 | 86 | 64 |
| 882352 | 97 | 88 | 75 | 48 |
| 882354 | 103 | 91 | 52 | 38 |
| 882357 | 106 | 91 | 68 | 36 |
| 882358 | 96 | 92 | 74 | 37 |
| 882359 | 98 | 99 | 94 | 64 |
| 882377 | 104 | 99 | 82 | 43 |
| 882384 | 96 | 82 | 67 | 39 |
| 882398 | 85 | 63 | 36 | 10 |
| 882408 | 91 | 68 | 41 | 11 |
| 882409 | 105 | 94 | 75 | 44 |
| 882429 | 105 | 99 | 90 | 74 |
| 882432 | 101 | 102 | 102 | 103 |
| 882479 | 98 | 99 | 94 | 83 |
| 882495 | 97 | 94 | 89 | 74 |
| 882532 | 93 | 92 | 78 | 41 |
| 882565 | 100 | 99 | 94 | 88 |

TABLE 103

Dose-dependent reduction of human IRF4 mRNA by modified oligonucleotides

| Compound Number | IRF4 expression (% UTC) | | | |
|---|---|---|---|---|
| | 62.5 nM | 250 nM | 1,000 nM | 4,000 nM |
| 609408 | 77 | 50 | 23 | 6 |
| 881955 | 92 | 75 | 43 | 11 |
| 881962 | 96 | 91 | 64 | 26 |
| 881963 | 95 | 100 | 93 | 76 |
| 882725 | 102 | 102 | 96 | 78 |
| 882744 | 104 | 107 | 93 | 74 |
| 882749 | 102 | 94 | 79 | 55 |
| 882758 | 108 | 94 | 76 | 44 |
| 882761 | 106 | 99 | 77 | 47 |
| 882765 | 99 | 89 | 61 | 34 |
| 882777 | 105 | 111 | 108 | 90 |
| 882797 | 107 | 96 | 78 | 44 |
| 882800 | 89 | 68 | 36 | 9 |
| 882806 | 99 | 96 | 84 | 60 |
| 882810 | 94 | 93 | 65 | 31 |
| 882833 | 101 | 102 | 83 | 67 |
| 882870 | 98 | 88 | 69 | 34 |
| 882871 | 103 | 90 | 75 | 55 |
| 882898 | 101 | 88 | 72 | 45 |

Example 21: Effect of Modified Oligonucleotides on Human IRF4 In Vitro, Multiple Doses Modified oligonucleotides selected from the examples above were tested at various doses in MM.1R cells. Cells were plated at a density of 5,000 cells per well and transfected by free uptake with 62.5 nM, 250 nM, 1,000 nM, and 4,000 nM concentrations of modified oligonucleotide, as specified in the tables below. After a treatment period of approximately 24 hours, RNA was isolated from the cells and IRF4 mRNA levels were measured by RT-qPCR. Human IRF4 primer probe set RTS4523 (described hereinabove in Example 19) was used to measure mRNA levels. IRF4 mRNA levels were adjusted according to total RNA content, as measured by RiboGreen. Results are presented as the percent level of IRF4 mRNA transcript, relative to that of untreated control (UTC) cells. As illustrated in the table below, IRF4 mRNA levels were reduced in a dose-dependent manner in cells treated with modified oligonucleotides.

TABLE 104

Dose-dependent reduction of human IRF4 mRNA by modified oligonucleotides

| Compound Number | IRF4 expression (% UTC) | | | |
|---|---|---|---|---|
| | 62.5 nM | 250 nM | 1,000 nM | 4,000 nM |
| 609408 | 84 | 47 | 22 | 5 |
| 881955 | 82 | 64 | 33 | 8 |
| 881962 | 109 | 79 | 63 | 25 |
| 881963 | 99 | 78 | 74 | 66 |
| 882725 | 85 | 72 | 76 | 60 |
| 882744 | 85 | 104 | 80 | 60 |
| 882749 | 114 | 95 | 64 | 50 |
| 882758 | 111 | 98 | 67 | 37 |
| 882761 | 114 | 108 | 75 | 32 |
| 882765 | 85 | 75 | 52 | 27 |
| 882777 | 83 | 95 | 79 | 63 |
| 882797 | 80 | 72 | 59 | 40 |
| 882800 | 53 | 60 | 28 | 7 |
| 882806 | 108 | 95 | 78 | 55 |
| 882810 | 128 | 119 | 69 | 34 |
| 882833 | 94 | 91 | 75 | 69 |
| 882870 | 114 | 97 | 71 | 31 |
| 882871 | 79 | 82 | 55 | 40 |
| 882898 | 81 | 73 | 58 | 34 |

Example 22: Effect of Modified Oligonucleotides on Human IRF4 In Vitro, Multiple Doses Modified oligonucleotides selected from the examples above were tested at various doses in MM.1R cells. Cells were plated at a density of 5,000 cells per well and transfected by free uptake with 62.5 nM, 250 nM, 1,000 nM, and 4,000 nM concentrations of modified oligonucleotide, as specified in the tables below. After a treatment period of approximately 24 hours, RNA was isolated from the cells and IRF4 mRNA levels were measured by RT-qPCR. Human IRF4 primer probe set RTS4522 (described hereinabove in Example 11) was used to measure mRNA levels. IRF4 mRNA levels were adjusted according to total RNA content, as measured by RiboGreen. Results are presented as the percent level of IRF4 mRNA transcript, relative to that of untreated control (UTC) cells. As illustrated in the tables below, IRF4 mRNA levels were reduced in a dose-dependent manner in cells treated with modified oligonucleotides.

TABLE 105

Dose-dependent reduction of human IRF4 mRNA by modified oligonucleotides

| Compound Number | IRF4 expression (% UTC) | | | | IC$_{50}$ (µM) |
|---|---|---|---|---|---|
| | 62.5 nM | 250 nM | 1,000 nM | 4,000 nM | |
| 609408 | 61 | 41 | 26 | 12 | 0.1 |
| 881450 | 68 | 59 | 41 | 26 | 0.4 |
| 881659 | 59 | 34 | 16 | 9 | 0.1 |
| 1013053 | 63 | 50 | 32 | 16 | 0.2 |
| 1013074 | 89 | 71 | 49 | 14 | 0.7 |
| 1013492 | 66 | 46 | 36 | 21 | 0.2 |
| 1013513 | 72 | 64 | 37 | 21 | 0.4 |
| 1013514 | 81 | 68 | 41 | 15 | 0.5 |
| 1013647 | 66 | 56 | 37 | 18 | 0.3 |
| 1013933 | 92 | 78 | 44 | 13 | 0.7 |
| 1013953 | 97 | 62 | 40 | 13 | 0.6 |
| 1014087 | 82 | 67 | 40 | 28 | 0.7 |
| 1014088 | 59 | 44 | 32 | 15 | 0.2 |
| 1014095 | 42 | 35 | 24 | 12 | <0.1 |
| 1014097 | 79 | 57 | 40 | 17 | 0.4 |
| 1014393 | 60 | 49 | 26 | 9 | 0.2 |
| 1014394 | 46 | 38 | 28 | 9 | <0.1 |
| 1014412 | 85 | 57 | 44 | 23 | 0.6 |
| 1014834 | 50 | 40 | 22 | 9 | <0.1 |

TABLE 106

Dose-dependent reduction of human IRF4 mRNA by modified oligonucleotides

| Compound Number | IRF4 expression (% UTC) | | | | IC$_{50}$ (µM) |
|---|---|---|---|---|---|
| | 62.5 nM | 250 nM | 1,000 nM | 4,000 nM | |
| 609408 | 63 | 46 | 28 | 15 | 0.2 |
| 881659 | 58 | 32 | 16 | 9 | 0.1 |
| 935607 | 57 | 41 | 28 | 16 | 0.1 |
| 1012795 | 66 | 43 | 26 | 7 | 0.2 |
| 1012819 | 92 | 75 | 35 | 25 | 0.7 |
| 1012821 | 52 | 38 | 28 | 11 | 0.1 |
| 1012836 | 103 | 69 | 44 | 19 | 0.8 |
| 1012882 | 94 | 60 | 31 | 11 | 0.5 |
| 1012883 | 60 | 42 | 28 | 11 | 0.1 |
| 1012884 | 49 | 39 | 25 | 14 | <0.1 |
| 1012900 | 90 | 72 | 42 | 22 | 0.7 |
| 1012914 | 55 | 42 | 25 | 10 | 0.1 |
| 1014968 | 56 | 48 | 35 | 16 | 0.2 |
| 1014976 | 76 | 43 | 37 | 14 | 0.3 |
| 1015254 | 68 | 46 | 31 | 14 | 0.2 |
| 1015275 | 86 | 61 | 24 | 12 | 0.4 |
| 1015409 | 66 | 53 | 34 | 16 | 0.3 |
| 1015417 | 76 | 56 | 37 | 16 | 0.4 |
| 1015716 | 59 | 46 | 24 | 10 | 0.1 |

Example 23: Effect of Modified Oligonucleotides on Human IRF4 In Vitro, Multiple Doses Modified oligonucleotides selected from the examples above were tested at various doses in KMS11 cells for their effects on target knockdown and on cell line proliferation.
Target Knockdown
KMS11 cells were plated at a density of 10,000 cells per well and transfected by free uptake with 8 nM, 40 nM, 200 nM, and 1,000 nM concentrations of modified oligonucleotide, as specified in the tables below. After a treatment period of approximately 48 hours, RNA was isolated from the cells and IRF4 mRNA levels were measured by RT-qPCR. Human IRF4 primer probe set RTS4522 (described hereinabove in Example 11) was used to measure mRNA levels. IRF4 mRNA levels were adjusted according to total RNA content, as measured by RiboGreen. Results are presented as the percent level of IRF4 mRNA transcript, relative to that of untreated control (UTC) cells. As illustrated in the tables below, IRF4 mRNA levels were reduced in a dose-dependent manner in cells treated with modified oligonucleotides.

TABLE 107

Dose-dependent reduction of human IRF4 mRNA by modified oligonucleotides

| Compound Number | IRF4 expression (% UTC) | | | |
|---|---|---|---|---|
| | 8 nM | 40 nM | 200 nM | 1,000 nM |
| 609408 | 79 | 67 | 38 | 14 |
| 935762 | 79 | 41 | 17 | 10 |
| 935918 | 71 | 35 | 14 | 10 |
| 936007 | 81 | 67 | 25 | 14 |
| 970527 | 90 | 53 | 23 | 15 |
| 882085 | 86 | 56 | 24 | 11 |
| 882408 | 74 | 70 | 37 | 17 |

TABLE 108

Dose-dependent reduction of human IRF4 mRNA by modified oligonucleotides

| Compound Number | IRF4 expression (% UTC) | | | |
|---|---|---|---|---|
| | 8 nM | 40 nM | 200 nM | 1,000 nM |
| 609408 | 92 | 69 | 30 | 13 |
| 882800 | 78 | 52 | 24 | 10 |
| 969933 | 96 | 88 | 72 | 61 |
| 1012795 | 70 | 41 | 18 | 9 |
| 1012821 | 84 | 53 | 39 | 20 |
| 1012884 | 85 | 51 | 26 | 17 |
| 1014095 | 82 | 41 | 19 | 10 |

TABLE 109

Dose-dependent reduction of human IRF4 mRNA by modified oligonucleotides

| Compound Number | IRF4 expression (% UTC) | | | |
|---|---|---|---|---|
| | 8 nM | 40 nM | 200 nM | 1,000 nM |
| 609408 | 89 | 67 | 30 | 14 |
| 1014393 | 80 | 50 | 22 | 12 |
| 1014394 | 86 | 74 | 38 | 19 |
| 1014834 | 86 | 51 | 17 | 9 |
| 1015716 | 95 | 78 | 43 | 17 |
| 881413 | 92 | 64 | 35 | 13 |
| 881449 | 94 | 85 | 48 | 22 |

TABLE 110

Dose-dependent reduction of human IRF4 mRNA by modified oligonucleotides

| Compound Number | IRF4 expression (% UTC) | | | |
|---|---|---|---|---|
| | 8 nM | 40 nM | 200 nM | 1,000 nM |
| 609408 | 98 | 78 | 33 | 15 |
| 935658 | 87 | 61 | 23 | 13 |
| 935696 | 90 | 48 | 17 | 11 |
| 935898 | 103 | 81 | 50 | 31 |
| 935928 | 92 | 48 | 17 | 11 |
| 935968 | 95 | 52 | 17 | 11 |
| 936006 | 99 | 81 | 38 | 19 |

Proliferation

KMS11 cells were plated at a density of 2,000 cells per well and transfected by free uptake with 8 nM, 40 nM, 200 nM, and 1,000 nM concentrations of modified oligonucleotide, as specified in the tables below. After seven days, CellTiterGlo-2.0 (Promega) was added and luminescence was measured on Glomax (Promega).

TABLE 111

Dose-dependent reduction of KMS11 proliferation by modified oligonucleotides

| Compound Number | IRF4 proliferation (% UTC) | | | |
|---|---|---|---|---|
| | 8 nM | 40 nM | 200 nM | 1,000 nM |
| 690890 | 93 | 79 | 22 | 7 |
| 935762 | 89 | 34 | 9 | 6 |
| 935918 | 85 | 28 | 8 | 7 |
| 936007 | 93 | 66 | 20 | 8 |
| 970527 | 92 | 50 | 11 | 5 |
| 882085 | 97 | 55 | 11 | 6 |
| 882408 | 95 | 68 | 25 | 10 |

TABLE 112

Dose-dependent reduction of KMS11 proliferation by modified oligonucleotides

| Compound Number | IRF4 proliferation (% UTC) | | | |
|---|---|---|---|---|
| | 8 nM | 40 nM | 200 nM | 1,000 nM |
| 690890 | 98 | 82 | 26 | 9 |
| 882800 | 87 | 48 | 16 | 9 |
| 969933 | 93 | 86 | 79 | 78 |
| 1012795 | 89 | 25 | 4 | 1 |
| 1012821 | 98 | 47 | 22 | 5 |
| 1012884 | 104 | 61 | 24 | 12 |
| 1014095 | 95 | 35 | 15 | 13 |

TABLE 113

Dose-dependent reduction of KMS11 proliferation by modified oligonucleotides

| Compound Number | IRF4 proliferation (% UTC) | | | |
|---|---|---|---|---|
| | 8 nM | 40 nM | 200 nM | 1,000 nM |
| 690890 | 91 | 67 | 21 | 7 |
| 1014393 | 89 | 45 | 15 | 9 |
| 1014394 | 91 | 70 | 26 | 11 |
| 1014834 | 86 | 43 | 12 | 6 |
| 1015716 | 92 | 78 | 32 | 12 |
| 881413 | 98 | 67 | 15 | 11 |
| 881449 | 97 | 81 | 39 | 21 |

TABLE 114

Dose-dependent reduction of KMS11 proliferation by modified oligonucleotides

| Compound Number | IRF4 proliferation (% UTC) | | | |
|---|---|---|---|---|
| | 8 nM | 40 nM | 200 nM | 1,000 nM |
| 690890 | 90 | 77 | 22 | 8 |
| 935658 | 91 | 51 | 11 | 7 |
| 935696 | 86 | 29 | 7 | 6 |
| 935898 | 96 | 82 | 56 | 38 |
| 935928 | 94 | 45 | 9 | 7 |

TABLE 114-continued

Dose-dependent reduction of KMS11 proliferation by modified oligonucleotides

| Compound | IRF4 proliferation (% UTC) | | | |
|---|---|---|---|---|
| Number | 8 nM | 40 nM | 200 nM | 1,000 nM |
| 935968 | 94 | 49 | 10 | 5 |
| 936006 | 97 | 80 | 26 | 12 |

Example 24: Effect of Modified Oligonucleotides on Human IRF4 In Vitro, Multiple Doses Modified oligonucleotides selected from the examples above were tested at various doses in H929 cells for their effects on target knockdown and on cell line proliferation.

Target Knockdown

H929 cells were plated at a density of 10,000 cells per well and transfected by free uptake with 8 nM, 40 nM, 200 nM, and 1,000 nM concentrations of modified oligonucleotide or 0.67 nM, 2 nM, 6.67 nM or 20 nM concentrations of modified oligonucleotide, as specified in the tables below. After a treatment period of approximately 48 hours, RNA was isolated from the cells and IRF4 mRNA levels were measured by RT-qPCR. Human IRF4 primer probe set RTS4522 (described hereinabove in Example 11) was used to measure mRNA levels. IRF4 mRNA levels were adjusted according to total RNA content, as measured by RiboGreen. Results are presented as the percent level of IRF4 mRNA transcript, relative to that of untreated control (UTC) cells. As illustrated in the tables below, IRF4 mRNA levels were reduced in a dose-dependent manner in cells treated with modified oligonucleotides.

TABLE 115

Dose-dependent reduction of human IRF4 mRNA by modified oligonucleotides

| Compound | IRF4 expression (% UTC) | | | |
|---|---|---|---|---|
| Number | 8 nM | 40 nM | 200 nM | 1,000 nM |
| 609408 | 88 | 66 | 39 | 34 |
| 935762 | 76 | 47 | 29 | 31 |
| 935918 | 70 | 43 | 34 | 24 |
| 936007 | 85 | 62 | 39 | 32 |
| 970527 | 83 | 49 | 41 | 24 |
| 882085 | 107 | 70 | 48 | 16 |
| 882408 | 99 | 88 | 59 | 42 |

TABLE 116

Dose-dependent reduction of human IRF4 mRNA by modified oligonucleotides

| Compound | IRF4 expression (% UTC) | | | |
|---|---|---|---|---|
| Number | 8 nM | 40 nM | 200 nM | 1,000 nM |
| 609408 | 69 | 53 | 35 | 30 |
| 882800 | 63 | 62 | 38 | 28 |
| 969933 | 112 | 95 | 87 | 83 |
| 1012795 | 72 | 67 | 45 | 31 |
| 1012821 | 69 | 86 | 47 | 35 |
| 1012884 | 82 | 88 | 51 | 32 |
| 1014095 | 71 | 68 | 31 | 21 |

TABLE 117

Dose-dependent reduction of human IRF4 mRNA by modified oligonucleotides

| Compound | IRF4 expression (% UTC) | | | |
|---|---|---|---|---|
| Number | 8 nM | 40 nM | 200 nM | 1,000 nM |
| 609408 | 88 | 57 | 31 | 37 |
| 1014393 | 70 | 43 | 38 | 24 |
| 1014394 | 83 | 60 | 43 | 32 |
| 1014834 | 84 | 45 | 33 | 23 |
| 1015716 | 88 | 75 | 46 | 17 |
| 881413 | 86 | 67 | 46 | 24 |
| 881449 | 109 | 90 | 63 | 51 |

TABLE 118

Dose-dependent reduction of human IRF4 mRNA by modified oligonucleotides

| Compound | IRF4 expression (% UTC) | | | |
|---|---|---|---|---|
| Number | 0.67 nM | 2 nM | 6.67 nM | 20 nM |
| 609408 | 74 | 53 | 26 | 37 |
| 935658 | 84 | 75 | 48 | 32 |
| 935696 | 78 | 59 | 33 | 26 |
| 935898 | 94 | 79 | 55 | 43 |
| 935928 | 74 | 54 | 36 | 28 |
| 935968 | 99 | 73 | 55 | 40 |
| 936006 | 91 | 74 | 61 | 52 |

Proliferation

H929 cells were plated at a density of 2,000 cells per well and transfected by free uptake with 8 nM, 40 nM, 200 nM, and 1,000 nM concentrations of modified oligonucleotide, as specified in the tables below. After seven days, CellTiterGlo-2.0 (Promega) was added and luminescence was measured on Glomax (Promega).

TABLE 119

Dose-dependent reduction of H929 proliferation by modified oligonucleotides

| Compound | IRF4 proliferation (% UTC) | | | |
|---|---|---|---|---|
| Number | 8 nM | 40 nM | 200 nM | 1,000 nM |
| 690890 | 94 | 69 | 32 | 12 |
| 935762 | 71 | 27 | 16 | 3 |
| 935918 | 87 | 58 | 26 | 2 |
| 936007 | 89 | 64 | 26 | 3 |
| 970527 | 95 | 58 | 15 | 1 |
| 882085 | 96 | 65 | 24 | 1 |
| 882408 | 88 | 65 | 45 | 9 |

TABLE 120

Dose-dependent reduction of H929 proliferation by modified oligonucleotides

| Compound | IRF4 proliferation (% UTC) | | | |
|---|---|---|---|---|
| Number | 8 nM | 40 nM | 200 nM | 1,000 nM |
| 690890 | 73 | 75 | 21 | 6 |
| 882800 | 89 | 87 | 30 | 4 |
| 969933 | 92 | 90 | 77 | 77 |
| 1012795 | 89 | 86 | 36 | 4 |
| 1012821 | 95 | 86 | 41 | 13 |

TABLE 120-continued

Dose-dependent reduction of H929 proliferation by modified oligonucleotides

| Compound | IRF4 proliferation (% UTC) | | | |
|---|---|---|---|---|
| Number | 8 nM | 40 nM | 200 nM | 1,000 nM |
| 1012884 | 68 | 62 | 9 | 2 |
| 1014095 | 78 | 63 | 22 | 5 |

TABLE 121

Dose-dependent reduction of H929 proliferation by modified oligonucleotides

| Compound | IRF4 proliferation (% UTC) | | | |
|---|---|---|---|---|
| Number | 8 nM | 40 nM | 200 nM | 1,000 nM |
| 690890 | 86 | 74 | 48 | 30 |
| 1014393 | 95 | 65 | 30 | 2 |
| 1014394 | 77 | 53 | 35 | 6 |
| 1014834 | 89 | 61 | 34 | 2 |
| 1015716 | 99 | 74 | 31 | 2 |
| 881413 | 85 | 53 | 33 | 4 |
| 881449 | 94 | 76 | 54 | 25 |

TABLE 122

Dose-dependent reduction of H929 proliferation by modified oligonucleotides

| Compound | IRF4 proliferation (% UTC) | | | |
|---|---|---|---|---|
| Number | 8 nM | 40 nM | 200 nM | 1,000 nM |
| 690890 | 92 | 79 | 52 | 30 |
| 935658 | 95 | 62 | 23 | 7 |
| 935696 | 84 | 60 | 32 | 3 |
| 935898 | 101 | 87 | 62 | 26 |
| 935928 | 75 | 50 | 25 | 6 |
| 935968 | 96 | 66 | 40 | 10 |
| 936006 | 98 | 73 | 38 | 9 |

Example 25: Effect of Modified Oligonucleotides on Human IRF4 In Vitro, Multiple Doses Modified oligonucleotides selected from the examples above were tested at various doses in ABC-DLBCL lines U2932 and TMD8 for their effects on target knockdown and on cell line proliferation.

Target Knockdown

Cells were plated at a density of 10,000 cells per well and transfected by free uptake with 50 nM, 200 nM, 1,000 nM, or 5,000 nM concentrations of modified oligonucleotide, as specified in the tables below. Control oligonucleotide ION 792169, a 3-10-3 cEt gapmer with the sequence CGCCGA-TAAGGTACAC (SEQ ID NO: 3384), was also included. After a treatment period of approximately 48 hours, RNA was isolated from the cells and IRF4 mRNA levels were measured by RT-qPCR. Human IRF4 primer probe set RTS4522 (described hereinabove in Example 11) was used to measure mRNA levels. IRF4 mRNA levels were adjusted according to total RNA content, as measured by RiboGreen. Results are presented as the percent level of IRF4 mRNA transcript, relative to untreated control (UTC) cells. As illustrated in the tables below, IRF4 mRNA levels were reduced in a dose-dependent manner in cells treated with modified oligonucleotides.

TABLE 123

Dose-dependent reduction of IRF4 expression by modified oligonucleotides in U2932 cells

| Compound | IRF4 expression (% UTC) | | | |
|---|---|---|---|---|
| Number | 50 nM | 200 nM | 1,000 nM | 5,000 nM |
| 792169 | 98 | 102 | 102 | 99 |
| 690890 | 84 | 64 | 55 | 38 |
| 882800 | 85 | 63 | 51 | 38 |
| 695696 | 71 | 62 | 54 | 49 |
| 695968 | 84 | 70 | 55 | 43 |
| 695918 | 83 | 64 | 47 | 33 |

TABLE 124

Dose-dependent reduction of IRF4 expression by modified oligonucleotides in TMD8 cells

| Compound | IRF4 expression (% UTC) | | | |
|---|---|---|---|---|
| Number | 50 nM | 200 nM | 1,000 nM | 5,000 nM |
| 792169 | 115 | 99 | 99 | 91 |
| 690890 | 97 | 75 | 53 | 26 |
| 882800 | 97 | 64 | 38 | 19 |
| 695696 | 94 | 68 | 45 | 29 |
| 695968 | 95 | 63 | 46 | 25 |
| 695918 | 105 | 65 | 44 | 24 |

Proliferation

Cells were plated at a density of 2,000 cells per well and transfected by free uptake with 50 nM, 200 nM, 1,000 nM, or 5,000 nM concentrations of modified oligonucleotide, as specified in the tables below. After seven days, CellTiterGlo-2.0 (Promega) was added and luminescence was measured on Glomax (Promega).

TABLE 125

Dose-dependent reduction of proliferation of U2932 cells by modified oligonucleotides

| Compound | IRF4 proliferation (% UTC) | | | |
|---|---|---|---|---|
| Number | 50 nM | 200 nM | 1,000 nM | 5,000 nM |
| 792169 | 99 | 115 | 111 | 75 |
| 690890 | 111 | 109 | 63 | 2 |
| 882800 | 113 | 103 | 40 | 2 |
| 695696 | 107 | 111 | 77 | 17 |
| 695968 | 102 | 101 | 74 | 24 |
| 695918 | 89 | 100 | 70 | 7 |

TABLE 126

Dose-dependent reduction of proliferation of TMD8 cells by modified oligonucleotides

| Compound | IRF4 proliferation (% UTC) | | | |
|---|---|---|---|---|
| Number | 50 nM | 200 nM | 1,000 nM | 5,000 nM |
| 792169 | 93 | 108 | 102 | 98 |
| 690890 | 110 | 120 | 118 | 17 |
| 882800 | 132 | 149 | 108 | 27 |
| 695696 | 125 | 143 | 94 | 5 |
| 695968 | 85 | 131 | 131 | 10 |
| 695918 | 139 | 130 | 122 | 4 |

Example 26: Effect of Modified Oligonucleotides on Human IRF4 In Vitro, Multiple Doses Modified oligonucleotides selected from the examples above were tested at various doses in ALCL cell lines for their effects on target knockdown and on cell line proliferation.

Target Knockdown

Cells were plated at a density of 10,000 cells per well and transfected by free uptake with 16 nM, 80 nM, or 400 nM concentrations of modified oligonucleotide, or 40 nM, 200 nM, 1,000 nM, or 5,000 nM concentrations of modified oligonucleotide, as specified in the tables below. After a treatment period of approximately 48 hours, RNA was isolated from the cells and IRF4 mRNA levels were measured by RT-qPCR. Human IRF4 primer probe set RTS4522 (described hereinabove in Example 11) was used to measure mRNA levels. IRF4 mRNA levels were adjusted according to total RNA content, as measured by RiboGreen. Results are presented as the percent level of IRF4 mRNA transcript, relative to untreated control (UTC) cells. Control oligonucleotide 549148, a 3-10-3 cEt gapmer with the sequence GGCTACTACGCCGTCA (SEQ ID NO: 3385), was also included. As illustrated in the tables below, IRF4 mRNA levels were reduced in a dose-dependent manner in cells treated with modified oligonucleotides.

TABLE 127

Dose-dependent reduction of IRF4 expression by modified oligonucleotides in Karpas299 cells

| Compound Number | IRF4 expression (% UTC) | | | |
|---|---|---|---|---|
| | 16 nM | 80 nM | 400 nM | 2,000 nM |
| 549148 | 92 | 85 | 86 | 83 |
| 609408 | 85 | 65 | 39 | 23 |
| 609416 | 82 | 75 | 66 | 53 |

TABLE 128

Dose-dependent reduction of IRF4 expression by modified oligonucleotides in SupM2 cells

| Compound Number | IRF4 expression (% UTC) | | | |
|---|---|---|---|---|
| | 40 nM | 200 nM | 1,000 nM | 5,000 nM |
| 549148 | 109 | 100 | 118 | 117 |
| 609408 | 83 | 91 | 32 | 10 |
| 609416 | 93 | 85 | 48 | 21 |

Proliferation

Cells were plated at a density of 2,000 cells per well and transfected by free uptake with 50 nM, 200 nM, 1,000 nM, or 5,000 nM concentrations of modified oligonucleotide, as specified in the tables below. After seven days, CellTiterGlo-2.0 (Promega) was added and luminescence was measured on Glomax (Promega).

TABLE 129

Dose-dependent reduction of proliferation of Karpas299 cells by modified oligonucleotides

| Compound Number | IRF4 proliferation (% UTC) | | | |
|---|---|---|---|---|
| | 50 nM | 200 nM | 1,000 nM | 5,000 nM |
| 549148 | 99 | 106 | 106 | 89 |
| 609408 | 105 | 91 | 31 | 22 |
| 609416 | 104 | 119 | 72 | 59 |

TABLE 130

Dose-dependent reduction of proliferation of SupM2 cells by modified oligonucleotides

| Compound Number | IRF4 proliferation (% UTC) | | | |
|---|---|---|---|---|
| | 16 nM | 80 nM | 400 nM | 2,000 nM |
| 549148 | 93 | 97 | 94 | 85 |
| 609408 | 93 | 96 | 55 | 3 |
| 609416 | 93 | 98 | 49 | 15 |

Example 27: Effect of Modified Oligonucleotides on Human IRF4 In Vitro, Multiple Doses Modified oligonucleotides selected from the examples above were tested at various doses in mantle cell lymphoma (MCL) lines MAVER1, JVM2, Granta519, Mino, and Z138 for their effects on target knockdown and on cell line proliferation.

Target Knockdown

Cells were plated at a density of 10,000 cells per well and transfected by free uptake with 40 nM, 200 nM, 1,000 nM, or 5,000 nM concentrations of modified oligonucleotide, as specified in the tables below. Control oligonucleotide 549148, a 3-10-3 cEt gapmer with the sequence GGCTACTACGCCGTCA (SEQ ID NO: 3385), was also included. After a treatment period of approximately 48 hours, RNA was isolated from the cells and IRF4 mRNA levels were measured by RT-qPCR. Human IRF4 primer probe set RTS4522 (described hereinabove in Example 11) was used to measure mRNA levels. IRF4 mRNA levels were adjusted according to total RNA content, as measured by RiboGreen. Results are presented as the percent level of IRF4 mRNA transcript, relative to untreated control (UTC) cells. As illustrated in the tables below, IRF4 mRNA levels were reduced in a dose-dependent manner in cells treated with modified oligonucleotides.

TABLE 131

Dose-dependent reduction of IRF4 expression by modified oligonucleotides in MAVER1 cells

| Compound Number | IRF4 expression (% UTC) | | | |
|---|---|---|---|---|
| | 40 nM | 200 nM | 1,000 nM | 5,000 nM |
| 549148 | 115 | 103 | 96 | 99 |
| 609408 | 121 | 102 | 80 | 35 |
| 609416 | 108 | 109 | 87 | 65 |

TABLE 132

Dose-dependent reduction of IRF4 expression by modified oligonucleotides in JVM2 cells

| Compound | IRF4 expression (% UTC) | | | |
|---|---|---|---|---|
| Number | 40 nM | 200 nM | 1,000 nM | 5,000 nM |
| 549148 | 108 | 114 | 108 | 100 |
| 609408 | 90 | 72 | 66 | 39 |
| 609416 | 101 | 82 | 74 | 93 |

TABLE 133

Dose-dependent reduction of IRF4 expression by modified oligonucleotides in Granta519 cells

| Compound | IRF4 expression (% UTC) | | | |
|---|---|---|---|---|
| Number | 40 nM | 200 nM | 1,000 nM | 5,000 nM |
| 549148 | 106 | 95 | 95 | 65 |
| 609408 | 176 | 165 | 134 | 122 |
| 609416 | 119 | 168 | 130 | 97 |
| 690890 | 161 | 160 | 143 | 102 |

TABLE 134

Dose-dependent reduction of IRF4 expression by modified oligonucleotides in Mino cells

| Compound | IRF4 expression (% UTC) | | | |
|---|---|---|---|---|
| Number | 40 nM | 200 nM | 1,000 nM | 5,000 nM |
| 549148 | 123 | 116 | 112 | 78 |
| 609408 | 124 | 109 | 67 | 31 |
| 609416 | 123 | 119 | 113 | 92 |
| 690890 | 122 | 116 | 103 | 42 |

TABLE 135

Dose-dependent reduction of IRF4 expression by modified oligonucleotides in Z138 cells

| Compound | IRF4 expression (% UTC) | | | |
|---|---|---|---|---|
| Number | 40 nM | 200 nM | 1,000 nM | 5,000 nM |
| 549148 | 68 | 72 | 78 | 19 |
| 609408 | 67 | 69 | 78 | 59 |
| 609416 | 76 | 69 | 89 | 72 |
| 690890 | 69 | 67 | 78 | 28 |

Proliferation

Cells were plated at a density of 2,000 cells per well and transfected by free uptake with 50 nM, 200 nM, 1,000 nM, or 5,000 nM concentrations of modified oligonucleotide, as specified in the tables below. After seven days, CellTiterGlo-2.0 (Promega) was added and luminescence was measured on Glomax (Promega).

TABLE 136

Dose-dependent reduction of proliferation of MAVER1 cells by modified oligonucleotides

| Compound | IRF4 proliferation (% UTC) | | | |
|---|---|---|---|---|
| Number | 80 nM | 400 nM | 2,000 nM | 10,000 nM |
| 549148 | 108 | 103 | 104 | 102 |
| 609408 | 104 | 102 | 83 | 40 |
| 609416 | 106 | 100 | 94 | 60 |

TABLE 137

Dose-dependent reduction of proliferation of JVM2 cells by modified oligonucleotides

| Compound | IRF4 proliferation (% UTC) | | | |
|---|---|---|---|---|
| Number | 80 nM | 400 nM | 2,000 nM | 10,000 nM |
| 549148 | 108 | 114 | 108 | 100 |
| 609408 | 117 | 95 | 66 | 37 |
| 609416 | 114 | 101 | 97 | 86 |

TABLE 138

Dose-dependent reduction of proliferation of Granta519 cells by modified oligonucleotides

| Compound | IRF4 proliferation (% UTC) | | | |
|---|---|---|---|---|
| Number | 80 nM | 400 nM | 2,000 nM | 10,000 nM |
| 549148 | 110 | 99 | 95 | 106 |
| 609408 | 34 | 10 | 4 | 2 |
| 609416 | 85 | 44 | 19 | 9 |
| 690890 | 58 | 24 | 12 | 7 |

TABLE 139

Dose-dependent reduction of proliferation of Mino cells by modified oligonucleotides

| Compound | IRF4 proliferation (% UTC) | | | |
|---|---|---|---|---|
| Number | 80 nM | 400 nM | 2,000 nM | 10,000 nM |
| 549148 | 90 | 103 | 106 | 101 |
| 609408 | 93 | 82 | 54 | 22 |
| 609416 | 94 | 84 | 68 | 56 |
| 690890 | 88 | 77 | 68 | 49 |

TABLE 140

Dose-dependent reduction of proliferation of Z138 cells by modified oligonucleotides

| Compound | IRF4 proliferation (% UTC) | | | |
|---|---|---|---|---|
| Number | 80 nM | 400 nM | 2,000 nM | 10,000 nM |
| 549148 | 91 | 88 | 89 | 82 |
| 609408 | 98 | 83 | 70 | 46 |
| 609416 | 91 | 82 | 74 | 56 |
| 690890 | 95 | 84 | 74 | 50 |

Example 28: In Vivo Activity in MM1.R Xenograft Model

A xenograft MM1.R model was used to evaluate activity of modified oligonucleotides targeted to human IRF4. Female NOD/SCID mice (JAX) at 4-6 weeks of age were given a subcuntaneous injection of 6 million MM1.R cells to form a xenograft tumor. Two weeks later, groups of 3 mice were administered 25, 50, or 100 mg/kg/dose modified oligonucleotide once a day for three days by subcutaneous injection. One group of mice received subcutaneous injections of PBS once a day for three days. The saline-injected group served as the control group to which oligonucleotide-treated groups were compared. Mice were sacrificed 48 hours after the final dose and tumors were collected for further analysis.

RNA Analysis

RNA was extracted from tumor tissue for RT-PCR analysis, which was performed as described above. Data were analyzed with primer probe set 34726, described above in Example 7 or primer probe set 35624 (forward sequence TCCCGTGTTGCTTCAAACT, designated herein as SEQ ID NO: 3395; reverse sequence TACCTGCTGGCAGTTCTTTC, designated herein as SEQ ID NO: 3396; probe sequence ACAGATGGGACTTAACAGGCAATGGG, designated herein as SEQ ID: 3397), which specifically detect human IRF4, as indicated in the tables below. Results are presented as percent change of mRNA, relative to PBS control, normalized with human B-Actin levels from the human tumor cells and mouse stromal cells using human specific primer probe set 5002 (forward sequence CGGACTATGACTTAGTTGCGTTAC; designated herein as SEQ ID NO: 3398; reverse sequence GCCATGCCAATCTCATCTTGT, designated herein as SEQ ID NO: 3399; probe sequence CCTTTCTTGACAAAACCTAACTTGCGCAGA, designated herein as SEQ ID NO: 3400).

TABLE 141

Activity of modified oligonucleotides in MM1.R xenograft model

| Compound ID | Dose | PPset | IRF4 mRNA (% PBS) |
|---|---|---|---|
| PBS | n/a | 34726 | 100 |
| 690890 | 25 | 34726 | 59 |
|  | 50 | 34726 | 53 |
|  | 100 | 34726 | 24 |
| 882800 | 50 | 34726 | 43 |
|  | 100 | 34726 | 18 |
| 935658 | 50 | 34726 | 52 |
|  | 100 | 34726 | 22 |
| 935918 | 50 | 34726 | 39 |
|  | 100 | 34726 | 18 |
| 935968 | 50 | 34726 | 52 |
|  | 100 | 34726 | 22 |
| 1012795 | 50 | 34726 | 45 |
|  | 100 | 34726 | 26 |
| 1014095 | 50 | 34726 | 71 |
|  | 100 | 34726 | 34 |
| 1014834 | 50 | 34726 | 56 |
|  | 100 | 34726 | 32 |
| 935762 | 50 | 34726 | 31 |
|  | 100 | 34726 | 27 |

TABLE 142

Activity of modified oligonucleotides in MM1.R xenograft model

| PBS | n/a | 34726 | 100 |
|---|---|---|---|
| 935696 | 50 | 34726 | 28 |
|  | 100 | 34726 | 13 |

TABLE 143

Activity of modified oligonucleotides in MM1.R xenograft model

| Compound ID | Dose | Ppset | IRF4 mRNA (% PBS) |
|---|---|---|---|
| PBS | n/a | 35624 | 100 |
| 690890 | 50 | 35624 | 55 |
|  | 100 | 35624 | 33 |
| 882800 | 50 | 35624 | 51 |
|  | 100 | 35624 | 31 |
| 935658 | 50 | 35624 | 56 |
|  | 100 | 35624 | 27 |
| 935918 | 50 | 35624 | 39 |
|  | 100 | 35624 | 9.9 |
| 935968 | 50 | 35624 | 26 |
|  | 100 | 35624 | 9.1 |
| 1012795 | 50 | 35624 | 18 |
|  | 100 | 35624 | 21 |
| 1014095 | 50 | 35624 | 28 |
|  | 100 | 35624 | 27 |
| 1014834 | 50 | 35624 | 33 |
|  | 100 | 35624 | 15 |
| 935762 | 50 | 35624 | 37 |
|  | 100 | 35624 | 22 |
| 935696 | 50 | 35624 | 19 |
|  | 100 | 35624 | 15 |

Protein Analysis

Levels of hIRF4 protein were measured in the xenograft tumors by a human-specific IRF4 antibody (abcam EP5699) on the WES system (ProteinSimple).

Levels of Igλ, a clinically-relevant biomarker for MM, were also measured on the WES system. Reductions of hIRF4 and Igλ were observed.

TABLE 144

Protein Levels in MM1.R Xenografts

| Compound ID | Dose (mg/kg/day) | IRF4 Protein (% PBS) | Igλ Protein (% PBS) |
|---|---|---|---|
| PBS | n/a | 100 | 100 |
| 690890 | 50 | 53 | 83 |
|  | 100 | 28 | 64 |
| 882800 | 50 | 67 | 88 |
|  | 100 | 27 | 68 |
| 935918 | 50 | 41 | 103 |
|  | 100 | 17 | 57 |
| 935968 | 50 | 36 | 91 |
|  | 100 | 15 | 52 |
| 1012795 | 50 | 32 | 105 |
|  | 100 | 14 | 60 |
| 1014095 | 50 | 35 | 78 |
|  | 100 | 15 | 56 |
| 1014834 | 50 | 57 | 83 |
|  | 100 | 31 | 69 |
| 935762 | 50 | 46 | 69 |
|  | 100 | 22 | 54 |
| 935696 | 50 | 26 | 40 |
|  | 100 | 15 | 37 |
| 935658 | 50 | 45 | 102 |
|  | 100 | 24 | 80 |

Example 29: Anti-Tumor Activity of Modified Oligonucleotides in a MM1.R Xenograft Model A xenograft MM1.R model was used to evaluate activity of modified oligonucleotides targeted to human IRF4. Female NOD-SCID mice at 5-6 weeks of age were given a subcuntaneous injection of 3 million MM1.R cells to form a xenograft tumor. 23 days later, groups of 8 mice were administered 50 mg/kg/dose modified oligonucleotide five times a week by subcutaneous injection for 3.5 weeks. One group of mice received subcutaneous injections of PBS five times a week. The saline-injected group served as the control group to which oligonucleotide-treated groups were compared. Tumor volume was estimated by caliper measurement. Mice were sacrificed 24 hours after the last dose and tissue was collected for RNA and protein analysis.

Tumor Volume

TABLE 145

Tumor volume (mm³)

| Compound ID | Days after MM1.R Cell Injection | | | | | |
|---|---|---|---|---|---|---|
| | 23 | 27 | 30 | 34 | 37 | 41 | 44 |
| PBS | 215 | 374 | 590 | 936 | 1597 | 1877* | 2530* |
| 792169 | 228 | 400 | 615 | 1194 | 1451 | 1669* | 2394* |
| 1014834 | 225 | 319 | 451 | 606 | 931 | 1202 | 1733 |
| 1014095 | 222 | 291 | 504 | 554 | 886 | 795* | 932* |
| 1012795 | 221 | 355 | 459 | 472 | 610* | n.d. | n.d. |
| 935968 | 210 | 313 | 463 | 587 | 771 | 447* | 585* |
| 935918 | 219 | 346 | 569 | 705 | 899 | 746* | 1024* |
| 935696 | 219 | 357 | 422 | 422 | 379 | 364 | 426 |
| 935658 | 269 | 340 | 557 | 619 | 856 | 983 | 1299 |
| 935762 | 220 | 290 | 397 | 488* | 593* | 770* | 949* |
| 882800 | 218 | 394 | 520 | 735 | 1075 | 907* | 1279* |
| 690890 | 216 | 307 | 419 | 498 | 643 | 830 | 1191 |

*Values represent the average of 3-7 mice

Body Weight

Body weights were measured throughout the study as a measure of tolerability.

TABLE 146

Body Weight (% of Day 23)

| Compound ID | Days after MM1.R Cell Injection | | | | | |
|---|---|---|---|---|---|---|
| | 23 | 27 | 30 | 34 | 37 | 41 | 44 |
| PBS | 100 | 101 | 101 | 106 | 104* | 111* | 115* |
| 792169 | 100 | 106 | 106 | 116 | 121* | 121* | 126* |
| 1014834 | 100 | 102 | 101 | 103 | 107 | 107 | 108 |
| 1014095 | 100 | 100 | 98 | 98 | 98* | 98* | 95* |
| 1012795 | 100 | 101 | 97 | 82 | n.d. | n.d. | n.d. |
| 935968 | 100 | 102 | 101 | 103 | 102* | 102* | 101* |
| 935918 | 100 | 101 | 101 | 102 | 100* | 100* | 98* |
| 935762 | 100 | 102 | 99 | 103 | 104 | 104 | 100 |
| 935696 | 100 | 104 | 103 | 105 | 101 | 101 | 97 |
| 935658 | 100 | 100 | 100 | 100 | 98 | 98 | 95 |
| 882800 | 100 | 102 | 101 | 106 | 103* | 103* | 98* |
| 690890 | 100 | 100 | 97 | 96 | 93 | 93 | 94 |

*Values represent the average of 3-7 animals

Liver Function

To evaluate the effect of modified oligonucleotides on hepatic function, plasma levels of transaminases were measured using an automated clinical chemistry analyzer (Hitachi Olympus AU400e, Melville, N.Y.). Plasma levels of ALT (alanine transaminase) were measured and the results are presented in the table below expressed in IU/L.

TABLE 147

Liver Transaminases

| Compound ID | ALT (IU/L) |
|---|---|
| PBS | 24 |
| 792169 | 45 |
| 1014834 | 894 |
| 1014095 | 1601 |
| 1012795 | 1915 |

TABLE 147-continued

Liver Transaminases

| Compound ID | ALT (IU/L) |
|---|---|
| 935968 | 289 |
| 935918 | 192 |
| 935762 | 1016 |
| 935696 | 1334 |
| 935658 | 91 |
| 882800 | 5219 |
| 690890 | 496 |

RNA and Protein Analysis

IRF4 mRNA in tumor samples was measured by RT-PCR using PPset RTS34726, described above. IRF4 protein in tumor samples was determined by western blot as described in Example 28 above.

TABLE 148

IRF4 Protein and mRNA Levels

| | hIRF4 mRNA Level | hIRF4 Protein Level |
|---|---|---|
| PBS | 98 | 100 |
| 792169 | 159 | 110 |
| 1014834 | 53 | 39 |
| 1014095 | 58 | 43 |
| 1012795 | 37 | n.d. |
| 935968 | 41 | 35 |
| 935918 | 28 | 31 |
| 935762 | 47 | 34 |
| 935696 | 39 | 27 |
| 935658 | 51 | 43 |
| 882800 | 57 | 32 |
| 690890 | 49 | 46 |

Example 30: Efficacy of Modified Oligonucleotides Targeted to hIRF4 in a Systemically Disseminated MM1.R Model with Bone Marrow Involvement A systemically disseminated MM1.R model was used to evaluate activity of modified oligonucleotides targeted to human IRF4. Female nod-scid IL2Rγ$^{null}$ mice at 4-6 weeks of age were first administered 50 mg/kg cyclophosphamide on day 0, and on day 1 were administrated 10 million MM1.R cells via an intravenous injection. On day 14, plasma human Igλ was tested by ELISA and mice were randomized to groups based on these results. Starting on day 21, groups of 4 mice were administered 50 mg/kg/day modified oligonucleotide once a day for three days, and sacrificed 48 hours after the last dose. Levels of hIRF4 mRNA were measured in bone marrow. The tumor burden was measured by measuring levels of hActin mRNA. Results are presented as percent change of mRNA, relative to PBS control treated mice.

TABLE 149

Bone marrow IRF4 mRNA and Tumor Burden.

| Compound ID | IRF4 mRNA in bone marrow (% PBS) | Tumor Burden |
|---|---|---|
| PBS | 100 | 4276 |
| 792169 | 70 | 830 |
| 882800 | 24 | 33 |
| 935918 | 36* | 118 |

TABLE 149-continued

Bone marrow IRF4 mRNA and Tumor Burden.

| Compound ID | IRF4 mRNA in bone marrow (% PBS) | Tumor Burden |
|---|---|---|
| 935696 | 38* | 559 |
| 935968 | 34* | 18 |

*Values represent the average of 1-3 mice, excluding mice with undetectable hIRF mRNA levels in bone marrow.

Example 31: Efficacy of Modified Oligonucleotides Targeted to hIRF4 in a Systemically Disseminated MM1.R Model with Bone Marrow Involvement A systemically disseminated MM1.R model was used to evaluate activity of modified oligonucleotides targeted to human IRF4. Female NOD-SCID IL2Rγ$^{null}$ mice at 4-6 weeks of age were first administered 50 mg/kg cyclophosphamide on day 0, and on day 1 were administrated 10 million MM1.R cells via an intravenous injection. On day 14, serum human Igλ was tested by ELISA and mice were randomized to groups based on these results. Starting on day 15, groups of ten mice were administered modified oligonucleotide with a loading dose of 50 mg/kg/day for 1 week, and then 3 doses a week at 50 mg/kg/day continuing until animal death, bodyweight drop of <20% or paralysis. One group of ten mice was administered PBS as a control, and another group was administered the control oligonucleotide 792169.

TABLE 150

Survival Percentage

| Treatment Day | PBS | 792169 | 882800 | 935918 | 935696 | 935968 |
|---|---|---|---|---|---|---|
| 0 | 100 | 100 | 100 | 100 | 100 | 100 |
| 40 | 90 | 60 | 100 | 100 | 100 | 100 |
| 42 | 90 | 60 | 90 | 100 | 90 | 100 |
| 43 | 60 | 60 | 90 | 100 | 90 | 100 |
| 44 | 40 | 20 | 90 | 100 | 90 | 100 |
| 45 | 20 | 0 | 90 | 100 | 80 | 100 |
| 46 | 0 | 0 | 90 | 100 | 80 | 100 |
| 49 | 0 | 0 | 70 | 90 | 80 | 100 |
| 51 | 0 | 0 | 70 | 90 | 80 | 100 |

Example 32: Activity of Modified Oligonucleotides Targeting hIRF4 in a TMD8 Human ABC-DLBCL Tumor Model A xenograft tumor model was used to evaluate activity of modified oligonucleotides targeted to human IRF4. 4 million ABC-DLBCL TMD8 cells were implanted into the flanks of 5 week old female NOD/SCID mice. When tumors reached an average volume of 100 mm$^3$, approximately two weeks post-implantation, groups of eight mice were administered 50 mg/kg/day modified oligonucleotide for two weeks. Mice were sacrificed after the last dose and tumors were collected for mRNA analysis.

Tumor volume was estimated with caliper measurement. Levels of hIRF4 mRNA were measured in tumor tissue and normalized to control animals.

TABLE 151

Tumor volume (mm$^3$)

| | Days post-implantation | | | | | | |
|---|---|---|---|---|---|---|---|
| Compound ID | 15 | 19 | 22 | 25 | 27 | 29 | 32 |
| | | | Tumor Volume (mm$^3$) | | | | |
| PBS | 112 | 276 | 602 | 872 | 1162 | 1365 | 2012 |
| 792169 | 112 | 232 | 488 | 797 | 1044 | 1359 | 1850 |
| 690890 | 114 | 206 | 392 | 481 | 589 | 675 | 777 |
| 882800 | 113 | 227 | 417 | 603 | 712 | 729 | 860 |
| 935696 | 113 | 225 | 448 | 570 | 676 | 761 | 729 |

TABLE 152 hIRF4 mRNA levels

| | hIRF4 mRNA Level |
|---|---|
| PBS | 100 |
| 792169 | 127 |
| 690890 | 84 |
| 882800 | 72 |
| 935696 | 58 |

Example 33: Tolerability of Modified Oligonucleotides Targeting hIRF4 in Balb/c Mice Balb/c mice are frequently utilized for safety and efficacy testing. The mice were treated with antisense oligonucleotides selected from studies described above and evaluated for changes in the levels of various plasma chemistry markers.

Treatment

Groups of 4-6 week old male Balb/c mice were injected subcutaneously twice a week for four weeks with 50 mg/kg of modified oligonucleotides (100 mg/kg/week dose). One group of male Balb/c mice was injected subcutaneously twice a week for 4 weeks with PBS. Mice were euthanized 48 hours after the last dose, and organs and plasma were harvested for further analysis.

Plasma Chemistry Markers

To evaluate the effect of modified oligonucleotides on liver and kidney function, plasma levels of transaminases, bilirubin, and BUN were measured using an automated clinical chemistry analyzer (Hitachi Olympus AU400e, Melville, N.Y.). The results are presented in the table below. Modified oligonucleotides that caused changes in the levels of any of the liver or kidney function markers outside the expected range for modified oligonucleotides were excluded in further studies.

TABLE 153

Plasma chemistry markers in Balb/c mouse plasma at week 4

| Compound ID | ALT (U/L) | AST (U/L) | BUN (mg/dL) | T. Bil (mg/dL) |
|---|---|---|---|---|
| PBS | 37 | 84 | 22.9 | 0.25 |
| 609296 | n.d. | n.d. | n.d. | n.d. |
| 609343 | n.d. | n.d. | n.d. | n.d. |
| 609354 | n.d. | n.d. | n.d. | n.d. |
| 609357 | n.d. | n.d. | n.d. | n.d. |
| 609391 | 1799 | 1362 | 16.7 | 0.31 |
| 609408 | 859 | 507 | 18.4 | 0.28 |
| 609416 | 93 | 114 | 21.1 | 0.23 |
| 609296 | n.d. | n.d. | n.d. | n.d. |

TABLE 153-continued

Plasma chemistry markers in Balb/c mouse plasma at week 4

| Compound ID | ALT (U/L) | AST (U/L) | BUN (mg/dL) | T. Bil (mg/dL) |
|---|---|---|---|---|
| 609547 | 982 | 802 | 27.3 | 0.34 |
| 609592 | 53 | 170 | 21.2 | 0.25 |

TABLE 154

Plasma chemistry markers in Balb/c mouse plasma at week 4

| Compound ID | ALT (U/L) | AST (U/L) | BUN (mg/dL) | T. Bil (mg/dL) |
|---|---|---|---|---|
| PBS | 35.8 | 53 | 21.1 | 0.25 |
| 666431 | 85.5 | 120 | 21.1 | 0.29 |
| 666440 | 8173 | 3432 | 26.2 | 3.84 |
| 666449 | 150 | 124 | 24.9 | 0.18 |
| 666471 | n.d. | n.d. | n.d. | n.d. |
| 666475 | 1989 | 1607 | 25.0 | 0.23 |
| 666496 | 2926 | 2423 | 22.4 | 0.30 |
| 666569 | 3427 | 3288 | 23.8 | 0.23 |
| 666575 | 525 | 385 | 24.5 | 0.21 |
| 666582 | 3543 | 2893 | 20.0 | 0.44 |
| 666584 | 43.3 | 57 | 25.4 | 0.21 |
| 666586 | 2970 | 2051 | 23.8 | 0.26 |
| 666587 | 1057 | 964 | 28.1 | 0.16 |
| 666649 | 4662 | 3970 | 23.8 | 10.99 |
| 666683 | 1363 | 1657 | 21.3 | 0.19 |

TABLE 155

Plasma chemistry markers in Balb/c mouse plasma at week 4

| Compound ID | ALT (U/L) | AST (U/L) | BUN (mg/dL) | T. Bil (mg/dL) |
|---|---|---|---|---|
| PBS | 32 | 89 | 24.1 | 0.29 |
| 609555 | 737 | 238 | 25.9 | 0.15 |
| 666772 | n.d. | n.d. | n.d. | n.d |
| 666775 | n.d. | n.d. | n.d. | n.d |
| 668818 | n.d. | n.d. | n.d. | n.d |
| 668849 | 105 | 131 | 24.7 | 0.12 |
| 668850 | 547 | 394 | 27.8 | 0.11 |
| 668902 | 53 | 103 | 21.5 | 0.18 |
| 668934 | n.d. | n.d. | n.d. | n.d |
| 668936 | 2260 | 3211 | 24.8 | 0.13 |
| 668937 | 39 | 89 | 23.2 | 0.14 |
| 668947 | n.d. | n.d. | n.d. | n.d |
| 668998 | 102 | 101 | 21.7 | 0.14 |
| 668999 | 625 | 404 | 28.9 | 0.21 |
| 669018 | 198 | 157 | 28.1 | 0.17 |
| 669022 | 33 | 60 | 19.9 | 0.19 |
| 669040 | 176 | 170 | 23.2 | 0.11 |
| 669066 | 589 | 300 | 23.8 | 0.27 |
| 669067 | n.d. | n.d. | n.d. | n.d |
| 669068 | 95 | 137 | 20.0 | 0.16 |
| 669075 | 647 | 400 | 19.4 | 0.15 |

TABLE 156

Plasma chemistry markers in Balb/c mouse plasma at week 4

| Compound ID | ALT (U/L) | AST (U/L) | BUN (mg/dL) | T. Bil (mg/dL) |
|---|---|---|---|---|
| PBS | 21 | 77 | 22.8 | 0.16 |
| 690508 | n.d. | n.d. | n.d. | n.d. |
| 690509 | n.d. | n.d. | n.d. | n.d. |
| 690510 | n.d. | n.d. | n.d. | n.d. |
| 690511 | n.d. | n.d. | n.d. | n.d. |
| 690512 | n.d. | n.d. | n.d. | n.d. |

TABLE 156-continued

Plasma chemistry markers in Balb/c mouse plasma at week 4

| Compound ID | ALT (U/L) | AST (U/L) | BUN (mg/dL) | T. Bil (mg/dL) |
|---|---|---|---|---|
| 690514 | 595 | 440 | 19.3 | 0.15 |
| 690515 | n.d. | n.d. | n.d. | n.d. |
| 690522 | 2440 | 1878 | 26.6 | 0.23 |
| 690527 | n.d. | n.d. | n.d. | n.d. |
| 690861 | 933 | 752 | 12.2 | 0.19 |
| 690863 | 889 | 798 | 17.0 | 0.56 |
| 690865 | n.d. | n.d. | n.d. | n.d. |
| 690873 | 1844 | 1160 | 16.6 | 0.28 |
| 690875 | 887 | 770 | 16.3 | 0.16 |
| 690877 | n.d. | n.d. | n.d. | n.d. |
| 690879 | 887 | 652 | 22.2 | 0.21 |
| 690881 | 442 | 320 | 23.0 | 0.12 |
| 690883 | 1505 | 901 | 38.9 | 0.34 |
| 690890 | 76 | 64 | 25.6 | 0.14 |
| 690892 | 56 | 126 | 23.9 | 0.17 |
| 690898 | 47 | 120 | 27.4 | 0.11 |
| 691028 | n.d. | n.d. | n.d. | n.d. |
| 691032 | 588 | 216 | 216 | 0.16 |
| 691033 | 709 | 451 | 31.4 | 0.13 |

Organ Weights

Liver, kidney, and spleen weights were measured at the end of the study, and are presented as the percent change compared to PBS-treated animals in the table below. Modified oligonucleotides that caused any changes in organ weights outside the expected range for modified oligonucleotides were excluded from further studies.

TABLE 157

Organ Weights (g)

| Compound ID | Liver | Kidney | Spleen |
|---|---|---|---|
| PBS | 1.25 | 0.39 | 0.11 |
| 609296 | n.d. | n.d. | n.d. |
| 609343 | n.d. | n.d. | n.d. |
| 609354 | n.d. | n.d. | n.d. |
| 609357 | n.d. | n.d. | n.d. |
| 609391 | 1.29 | 0.32 | 0.23 |
| 609408 | 1.48 | 0.37 | 0.14 |
| 609416 | 1.57 | 0.38 | 0.14 |
| 609296 | n.d. | n.d. | n.d. |
| 609547 | 2.56 | 0.35 | 0.55 |
| 609592 | 1.41 | 0.37 | 0.13 |

TABLE 158

Organ Weights (g)

| Compound ID | Liver | Kidney | Spleen |
|---|---|---|---|
| PBS | 1.30 | 0.40 | 0.10 |
| 666431 | 1.21 | 0.38 | 0.15 |
| 666440 | 2.38 | 0.37 | 0.10 |
| 666449 | 1.39 | 0.40 | 0.11 |
| 666471 | n.d. | n.d. | n.d. |
| 666475 | 1.49 | 0.40 | 0.10 |
| 666496 | 1.66 | 0.44 | 0.12 |
| 666569 | 1.09 | 0.34 | 0.13 |
| 666575 | 1.33 | 0.37 | 0.10 |
| 666582 | 2.03 | 0.42 | 0.13 |
| 666584 | 1.34 | 0.40 | 0.11 |
| 666586 | 1.36 | 0.29 | 0.12 |
| 666587 | 1.77 | 0.38 | 0.11 |
| 666649 | 0.81 | 0.30 | 0.07 |
| 666683 | 2.05 | 0.38 | 0.12 |

TABLE 159

Organ weights (g)

| Compound ID | Liver (g) | Kidney (g) | Spleen (g) |
|---|---|---|---|
| PBS | 1.49 | 0.43 | 0.12 |
| 609555 | 1.50 | 0.36 | 0.17 |
| 666772 | n.d. | n.d. | n.d. |
| 666775 | n.d. | n.d. | n.d. |
| 668818 | n.d. | n.d. | n.d. |
| 668849 | 1.75 | 0.41 | 0.22 |
| 668850 | 1.96 | 0.41 | 0.16 |
| 668902 | 1.50 | 0.39 | 0.12 |
| 668934 | n.d. | n.d. | n.d. |
| 668936 | 1.97 | 0.33 | 0.13 |
| 668937 | 1.58 | 0.41 | 0.14 |
| 668947 | n.d. | n.d. | n.d. |
| 668998 | 1.53 | 0.38 | 0.16 |
| 668999 | 1.64 | 0.38 | 0.13 |
| 669018 | 1.92 | 0.41 | 0.14 |
| 669022 | 1.47 | 0.41 | 0.12 |
| 669040 | 1.66 | 0.44 | 0.11 |
| 669066 | 1.64 | 0.39 | 0.15 |
| 669067 | 1.52 | 0.38 | 0.13 |
| 669068 | n.d. | n.d. | n.d. |
| 669075 | 1.43 | 0.36 | 0.17 |

TABLE 160

Organ weights (g)

| Compound ID | Liver (g) | Kidney (g) | Spleen (g) |
|---|---|---|---|
| PBS | 0.86 | 0.29 | 0.10 |
| 690508 | n.d. | n.d. | n.d. |
| 690509 | n.d. | n.d. | n.d. |
| 690510 | n.d. | n.d. | n.d. |
| 690511 | n.d. | n.d. | n.d. |
| 690512 | n.d. | n.d. | n.d. |
| 690514 | 1.68 | 0.28 | 0.19 |
| 690515 | n.d. | n.d. | n.d. |
| 690522 | 1.40 | 0.26 | 0.11 |
| 690527 | n.d. | n.d. | n.d. |
| 690861 | 1.29 | 0.27 | 0.12 |
| 690863 | 1.27 | 0.27 | 0.15 |
| 690865 | n.d. | n.d. | n.d. |
| 690873 | 1.17 | 0.28 | 0.14 |
| 690875 | 1.36 | 0.28 | 0.17 |
| 690877 | n.d. | n.d. | n.d. |
| 690879 | 1.04 | 0.26 | 0.14 |
| 690881 | 1.19 | 0.28 | 0.13 |
| 690883 | 1.59 | 0.30 | 0.10 |
| 690890 | 0.97 | 0.27 | 0.13 |
| 690892 | 1.08 | 0.30 | 0.17 |
| 690898 | 1.08 | 0.30 | 0.15 |
| 691028 | n.d. | n.d. | n.d. |
| 691032 | 1.33 | 0.29 | 0.1525 |
| 691033 | 1.625 | 0.3175 | 0.125 |

Example 34: Tolerability of Modified Oligonucleotides Targeting hIRF4 in CD1 Mice CD1® mice (Charles River, Mass.) are frequently utilized for safety and efficacy testing. The mice were treated with antisense oligonucleotides selected from studies described above and evaluated for changes in the levels of various plasma chemistry markers.

Treatment

Groups of 4-6 week old male CD1 mice were injected subcutaneously twice a week for four weeks with 50 mg/kg of modified oligonucleotides (100 mg/kg/week dose). One group of male CD1 mice was injected subcutaneously twice a week for 4 weeks with PBS. Mice were euthanized 48 hours after the last dose, and organs and plasma were harvested for further analysis.

Plasma Chemistry Markers

To evaluate the effect of modified oligonucleotides on liver and kidney function, plasma levels of transaminases, bilirubin, and BUN were measured using an automated clinical chemistry analyzer (Hitachi Olympus AU400e, Melville, N.Y.). The results are presented in the table below. Modified oligonucleotides that caused changes in the levels of any of the liver or kidney function markers outside the expected range for modified oligonucleotides were excluded in further studies.

TABLE 161

Plasma chemistry markers in CD1 mouse plasma at week 4

| Compound ID | ALT (U/L) | AST (U/L) | BUN (mg/dL) | T. Bil (mg/dL) |
|---|---|---|---|---|
| PBS | 27 | 65 | 19.7 | 0.19 |
| 881413 | 43 | 78 | 19.3 | 0.18 |
| 881442 | 594 | 484 | 23.1 | 0.24 |
| 881449 | 36 | 52 | 19.9 | 0.24 |
| 881450 | 100 | 146 | 20.8 | 0.18 |
| 881506 | 683 | 417 | 8.7 | 0.18 |
| 881517 | 121 | 103 | 22.1 | 0.16 |
| 881581 | 501 | 413 | 23.7 | 0.27 |
| 881610 | 44 | 79 | 18.5 | 0.19 |
| 881658 | 39 | 66 | 16.0 | 0.17 |
| 881659 | 4924 | 3485 | 15.3 | 5.48 |
| 881660 | 267 | 176 | 19.7 | 0.16 |
| 881728 | 644 | 389 | 21.1 | 0.23 |
| 881742 | 780 | 443 | 17.6 | 0.23 |
| 882099 | 3607 | 1971 | 23.1 | 0.28 |
| 882282 | n.d. | n.d. | n.d. | n.d. |
| 882305 | 2688 | 1379 | 24.9 | 0.31 |
| 882433 | 2683 | 1944 | 19.5 | 0.42 |

TABLE 162

Plasma chemistry markers in CD1 mouse plasma at week 4

| Compound ID | ALT (U/L) | AST (U/L) | BUN (mg/dL) | T. Bil (mg/dL) |
|---|---|---|---|---|
| PBS | 23 | 69 | 17.0 | 0.19 |
| 881449 | 34 | 65 | 19.2 | 0.23 |
| 881582 | 206 | 211 | 18.6 | 0.15 |
| 881588 | 902 | 829 | 15.2 | 0.32 |
| 881658 | 334 | 226 | 14.0 | 0.18 |
| 881727 | 1120 | 748 | 16.8 | 0.40 |
| 792169 | 23 | 43 | 18.0 | 0.21 |

TABLE 163

Plasma chemistry markers in CD1 mouse plasma at week 4

| Compound ID | ALT (U/L) | AST (U/L) | BUN (mg/dL) | T. Bil (mg/dL) |
|---|---|---|---|---|
| PBS | 25 | 41 | 22.2 | 0.17 |
| 935765 | n.d. | n.d. | n.d. | n.d. |
| 935580 | n.d. | n.d. | n.d. | n.d. |
| 935805 | n.d. | n.d. | n.d. | n.d. |
| 935853 | n.d. | n.d. | n.d. | n.d. |
| 935824 | n.d. | n.d. | n.d. | n.d. |
| 935581 | n.d. | n.d. | n.d. | n.d. |
| 935689 | n.d. | n.d. | n.d. | n.d. |
| 935698 | 1462 | 1523 | 17.5 | 0.19 |
| 935699 | n.d. | n.d. | n.d. | n.d. |
| 935707 | 1334 | 703 | 17.3 | 0.21 |
| 935679 | n.d. | n.d. | n.d. | n.d. |
| 935727 | n.d. | n.d. | n.d. | n.d. |
| 935795 | n.d. | n.d. | n.d. | n.d. |
| 935898 | 101 | 129 | 20.3 | 0.18 |
| 935782 | 680 | 278 | 19.0 | 0.20 |

TABLE 163-continued

Plasma chemistry markers in CD1 mouse plasma at week 4

| Compound ID | ALT (U/L) | AST (U/L) | BUN (mg/dL) | T. Bil (mg/dL) |
|---|---|---|---|---|
| 935878 | 1805 | 1128 | 19.1 | 0.21 |
| 935850 | 661 | 492 | 21.2 | 0.08 |
| 935724 | 1630 | 1341 | 19.9 | 0.25 |
| 935658 | 53 | 65 | 19.5 | 0.24 |
| 935762 | 106 | 132 | 18.0 | 0.18 |
| 935851 | 513 | 300 | 18.0 | 0.13 |

TABLE 164

Plasma chemistry markers in CD1 mouse plasma at week 4

| Compound ID | ALT (U/L) | AST (U/L) | BUN (mg/dL) | T. Bil (mg/dL) |
|---|---|---|---|---|
| PBS | 19 | 34 | 18.6 | 0.17 |
| 935921 | 708 | 372 | 15.5 | 0.19 |
| 935961 | 1068 | 754 | 14.8 | 0.28 |
| 936018 | 609 | 358 | 17.9 | 0.14 |
| 936039 | n.d. | n.d. | n.d. | n.d. |
| 935708 | n.d. | n.d. | n.d. | n.d. |
| 935958 | 97 | 117 | 17.5 | 0.10 |
| 935854 | 304 | 205 | 18.6 | 0.14 |
| 935968 | 53 | 70 | 18.9 | 0.12 |
| 935620 | 1883 | 2950 | 17.2 | 1.17 |
| 935697 | 1504 | 763 | 16.9 | 0.22 |
| 935700 | 722 | 480 | 18.8 | 0.18 |
| 935734 | 1253 | 500 | 17.9 | 0.17 |
| 935857 | 1270 | 1233 | 17.7 | 0.29 |
| 936016 | 731 | 571 | 22.7 | 0.15 |
| 936006 | 38 | 47 | 16.9 | 0.13 |
| 936007 | 131 | 152 | 18.1 | 0.10 |
| 935948 | 192 | 183 | 19.5 | 0.15 |
| 935603 | 193 | 260 | 17.0 | 0.19 |
| 935701 | 426 | 277 | 18.0 | 0.06 |
| 935928 | 69 | 84 | 17.4 | 0.10 |

TABLE 165

Plasma chemistry markers in CD1 mouse plasma at week 4

| Compound ID | ALT (U/L) | AST (U/L) | BUN (mg/dL) | T. Bil (mg/dL) |
|---|---|---|---|---|
| PBS | 23 | 44 | 22.5 | 0.20 |
| 969991 | n.d. | n.d. | n.d. | n.d. |
| 970013 | n.d. | n.d. | n.d. | n.d. |
| 970043 | 636 | 610 | 19.6 | 0.33 |
| 970103 | 786 | 512 | 20.1 | 0.17 |
| 970117 | 1786 | 877 | 22.5 | 0.29 |
| 970139 | 1011 | 1244 | 21.0 | 1.69 |
| 970159 | 1772 | 3821 | 15.7 | 2.68 |
| 970162 | 470 | 422 | 18.0 | 0.15 |
| 970189 | 353 | 377 | 21.0 | 0.19 |
| 970212 | 1714 | 1062 | 22.7 | 1.00 |
| 970524 | n.d. | n.d. | n.d. | n.d. |
| 970527 | 182 | 181 | 18.1 | 0.12 |

TABLE 166

Plasma chemistry markers in CD1 mouse plasma at week 4

| Compound ID | ALT (U/L) | AST (U/L) | BUN (mg/dL) | T. Bil (mg/dL) |
|---|---|---|---|---|
| PBS | 24 | 99 | 20.1 | 0.21 |
| 881955 | 4127 | 3743 | 45.7 | 2.61 |
| 882085 | 53 | 73 | 22.3 | 0.18 |
| 882086 | 2522 | 2002 | 25.5 | 0.43 |

TABLE 166-continued

Plasma chemistry markers in CD1 mouse plasma at week 4

| Compound ID | ALT (U/L) | AST (U/L) | BUN (mg/dL) | T. Bil (mg/dL) |
|---|---|---|---|---|
| 882087 | 377 | 276 | 23.1 | 0.15 |
| 882175 | 575 | 554 | 9.4 | 0.68 |
| 882177 | 2666 | 3030 | 26.6 | 4.87 |
| 882228 | 893 | 1659 | 19.3 | 0.22 |
| 882398 | 980 | 1070 | 22.1 | 7.91 |
| 882408 | 46 | 69 | 17.9 | 0.17 |
| 882800 | 70 | 84 | 23.4 | 0.20 |
| 969933 | 383 | 272 | 21.7 | 0.15 |
| 969936 | n.d. | n.d. | n.d. | n.d. |
| 969938 | 1142 | 1009 | 18.1 | 0.76 |
| 970211 | 301 | 224 | 20.1 | 0.15 |
| 970249 | 1724 | 2104 | 20.0 | 6.21 |
| 970545 | 836 | 1049 | 24.8 | 0.34 |
| 970546 | 1248 | 1334 | 23.8 | 0.31 |
| 970547 | 878 | 665 | 18.4 | 0.53 |
| 970548 | 1607 | 3352 | 17.7 | 4.86 |
| 970552 | n.d. | n.d. | n.d. | n.d. |

TABLE 167

Plasma chemistry markers in CD1 mouse plasma at week 4

| Compound ID | ALT (U/L) | AST (U/L) | BUN (mg/dL) | T. Bil (mg/dL) |
|---|---|---|---|---|
| PBS | 23 | 44 | 19.7 | 0.22 |
| 1012795 | 143 | 235 | 20.9 | 0.16 |
| 1012821 | 1189 | 1434 | 24.6 | 0.22 |
| 1012884 | 1523 | 1939 | 27.0 | 0.69 |
| 1014095 | 63 | 71 | 19.4 | 0.18 |
| 1014393 | 666 | 627 | 19.3 | 0.25 |
| 1014394 | 117 | 129 | 17.8 | 0.16 |
| 1014834 | 301 | 190 | 19.7 | 0.21 |
| 1015716 | 230 | 205 | 18.4 | 0.17 |

TABLE 168

Plasma chemistry markers in CD1 mice plasma at week 4

| Compound ID | ALT (U/L) | AST (U/L) | T. Bil (mg/dL) | BUN (mg/dL) | Albumin |
|---|---|---|---|---|---|
| PBS | 21 | 45 | 0.190 | 21.8 | 2.54 |
| 935918 | 87 | 91 | 0.118 | 18.8 | 2.07 |
| 935696 | 71 | 108 | 0.143 | 21.7 | 2.22 |

Organ Weights

Liver, kidney, and spleen weights were measured at the end of the study, and are presented as the percent change compared to PBS-treated animals in the table below. Modified oligonucleotides that caused any changes in organ weights outside the expected range for modified oligonucleotides were excluded from further studies.

TABLE 169

Organ Weights (g)

| Compound ID | Liver | Kidney | Spleen |
|---|---|---|---|
| PBS | 2.1 | 0.56 | 0.141 |
| 881413 | 2.2 | 0.57 | 0.217 |
| 881442 | 2.7 | 0.52 | 0.186 |
| 881449 | 2.1 | 0.47 | 0.169 |
| 881450 | 2.2 | 0.50 | 0.151 |
| 881506 | 2.9 | 0.62 | 0.191 |
| 881517 | 2.4 | 0.48 | 0.180 |
| 881581 | 2.2 | 0.51 | 0.192 |

TABLE 169-continued

| | Organ Weights (g) | | |
|---|---|---|---|
| Compound ID | Liver | Kidney | Spleen |
| 881610 | 1.9 | 0.53 | 0.165 |
| 881658 | 2.0 | 0.54 | 0.158 |
| 881659 | 1.7 | 0.43 | 0.153 |
| 881660 | 1.9 | 0.52 | 0.175 |
| 881728 | 2.3 | 0.48 | 0.161 |
| 881742 | 1.9 | 0.48 | 0.127 |
| 882099 | 2.2 | 0.47 | 0.193 |
| 882282 | n.d. | n.d. | n.d. |
| 882305 | 2.1 | 0.52 | 0.181 |
| 882433 | 2.0 | 0.54 | 0.155 |

TABLE 170

| | Organ weights (g) | | |
|---|---|---|---|
| Compound ID | Liver | Kidney | Spleen |
| PBS | 1.8 | 0.54 | 0.111 |
| 881449 | 2.1 | 0.54 | 0.146 |
| 881582 | 2.0 | 0.48 | 0.177 |
| 881588 | 1.9 | 0.39 | 0.171 |
| 881658 | 2.2 | 0.58 | 0.188 |
| 881727 | 2.1 | 0.51 | 0.201 |
| 792169 | 1.9 | 0.55 | 0.128 |
| UTC | 2.0 | 0.69 | 0.144 |

TABLE 171

| | Organ weights (g) | | |
|---|---|---|---|
| Compound ID | Liver | Kidney | Spleen |
| PBS | 2.0 | 0.50 | 0.109 |
| 935765 | n.d. | n.d. | n.d. |
| 935580 | n.d. | n.d. | n.d. |
| 935805 | n.d. | n.d. | n.d. |
| 935853 | n.d. | n.d. | n.d. |
| 935824 | n.d. | n.d. | n.d. |
| 935581 | n.d. | n.d. | n.d. |
| 935689 | n.d. | n.d. | n.d. |
| 935698 | 2.4 | 0.55 | 0.213 |
| 935699 | n.d. | n.d. | n.d. |
| 935707 | 2.3 | 0.54 | 0.199 |
| 935679 | n.d. | n.d. | n.d. |
| 935727 | n.d. | n.d. | n.d. |
| 935795 | n.d. | n.d. | n.d. |
| 935898 | 2.2 | 0.58 | 0.245 |
| 935782 | 2.9 | 0.56 | 0.279 |
| 935878 | 2.7 | 0.56 | 0.192 |
| 935850 | 2.8 | 0.70 | 0.203 |
| 935724 | 2.6 | 0.45 | 0.110 |
| 935658 | 2.0 | 0.71 | 0.205 |
| 935762 | 2.3 | 0.57 | 0.197 |
| 935851 | 2.4 | 0.60 | 0.176 |

TABLE 172

| | Organ weights (g) | | |
|---|---|---|---|
| Compound ID | Liver | Kidney | Spleen |
| PBS | 1.9 | 0.52 | 0.117 |
| 935921 | 2.3 | 0.51 | 0.219 |
| 935961 | 2.1 | 0.53 | 0.190 |
| 936018 | 2.2 | 0.41 | 0.200 |
| 936039 | n.d. | n.d. | n.d. |
| 935708 | n.d. | n.d. | n.d. |
| 935958 | 2.2 | 0.47 | 0.219 |
| 935854 | 2.0 | 0.44 | 0.102 |

TABLE 172-continued

| | Organ weights (g) | | |
|---|---|---|---|
| Compound ID | Liver | Kidney | Spleen |
| 935968 | 2.4 | 0.58 | 0.157 |
| 935620 | 3.2 | 0.57 | 0.243 |
| 935697 | 2.9 | 0.56 | 0.208 |
| 935700 | 2.0 | 0.49 | 0.121 |
| 935734 | 2.7 | 0.55 | 0.162 |
| 935857 | 1.5 | 0.34 | 0.110 |
| 936016 | 2.8 | 0.57 | 0.416 |
| 936006 | 2.3 | 0.48 | 0.136 |
| 936007 | 2.3 | 0.55 | 0.149 |
| 935948 | 1.9 | 0.54 | 0.166 |
| 935603 | 1.6 | 0.49 | 0.125 |
| 935701 | 1.9 | 0.43 | 0.144 |
| 935928 | 2.3 | 0.53 | 0.155 |

TABLE 173

| | Organ weights (g) | | |
|---|---|---|---|
| Compound ID | Liver | Kidney | Spleen |
| PBS | 1.8 | 0.51 | 0.133 |
| 969991 | n.d. | n.d. | n.d. |
| 970013 | n.d. | n.d. | n.d. |
| 970043 | 2.3 | 0.48 | 0.238 |
| 970103 | 2.2 | 0.54 | 0.175 |
| 970117 | 3.2 | 0.48 | 0.255 |
| 970139 | 2.7 | 0.56 | 0.210 |
| 970159 | 2.7 | 0.62 | 0.183 |
| 970162 | 2.2 | 0.54 | 0.215 |
| 970189 | 3.1 | 0.45 | 0.135 |
| 970212 | 2.3 | 0.45 | 0.218 |
| 970524 | n.d. | n.d. | n.d. |
| 970527 | 2.4 | 0.60 | 0.178 |

TABLE 174

| | Organ weights (g) | | |
|---|---|---|---|
| Compound ID | Liver | Kidney | Spleen |
| PBS | 1.7 | 0.42 | 0.095 |
| 881955 | 1.8 | 0.32 | 0.110 |
| 882085 | 2.0 | 0.45 | 0.110 |
| 882086 | 4.9 | 0.41 | 0.258 |
| 882087 | 2.4 | 0.47 | 0.130 |
| 882175 | 1.4 | 0.46 | 0.098 |
| 882177 | 3.6 | 0.43 | 0.185 |
| 882228 | 2.8 | 0.49 | 0.193 |
| 882398 | 1.7 | 0.44 | 0.113 |
| 882408 | 2.0 | 0.51 | 0.135 |
| 882800 | 1.9 | 0.41 | 0.128 |
| 969933 | 2.2 | 0.50 | 0.145 |
| 969936 | n.d. | n.d. | n.d. |
| 969938 | 1.8 | 0.45 | 0.150 |
| 970211 | 2.1 | 0.40 | 0.143 |
| 970249 | 3.3 | 0.65 | 0.190 |
| 970545 | 2.5 | 0.44 | 0.133 |
| 970546 | 0.9 | 0.28 | 0.060 |
| 970547 | 2.1 | 0.50 | 0.243 |
| 970548 | 2.8 | 0.52 | 0.260 |
| 970552 | n.d. | n.d. | n.d. |

TABLE 175

| Compound | Organ weights (g) | | |
|---|---|---|---|
| | Liver | Kidney | Spleen |
| PBS | 1.78 | 0.56 | 0.115 |
| 935918 | 2.44 | 0.62 | 0.167 |
| 935696 | 2.20 | 0.61 | 0.352 |

Example 35: Tolerability of Modified Oligonucleotides Targeting hIRF4 in Sprague-Dawley Rats Sprague-Dawley rats are a multipurpose model used for safety and efficacy evaluations. The rats were treated with modified antisense oligonucleotides from the studies described in the Examples above and evaluated for changes in the levels of various plasma chemistry markers.
Treatment Male Sprague-Dawley rats were maintained on a 12-hour light/dark cycle and fed ad libitum with Purina normal rat chow, diet 5001. Groups of 4 Sprague-Dawley rats each were injected subcutaneously once a week for 6 weeks with 50 mg/kg of ISIS oligonucleotide (50 mg/kg weekly dose). Forty eight hours after the last dose, rats were euthanized and organs and plasma were harvested for further analysis.
Liver and Kidney Function To evaluate the effect of modified oligonucleotides on hepatic function, plasma levels of transaminases were measured using an automated clinical chemistry analyzer (Hitachi Olympus AU400e, Melville, N.Y.). Plasma levels of ALT (alanine transaminase), AST (aspartate transaminase), blood urea nitrogen (BUN), and T. bilirubin were measured and the results are presented in the table below. Plasma levels of bilirubin were also measured using the same clinical chemistry analyzer and the results are also presented in the table below. Values represent the % change normalized to PBS-treated animals. Modified oligonucleotides that caused changes in the levels of any markers of liver function outside the expected range for antisense oligonucleotides were excluded in further studies.

TABLE 176

| Liver function markers in Sprague-Dawley rats | | | | | |
|---|---|---|---|---|---|
| Compound ID | ALT (IU/L) | AST (IU/L) | T. Bil (mg/dL) | BUN (mg/dL) | Albumin (g/dL) |
| PBS | 47 | 67 | 0.14 | 16.4 | 3.92 |
| 690898 | 41 | 73 | 0.17 | 20.7 | 3.19 |
| 881413 | 42 | 61 | 0.18 | 18.1 | 3.66 |
| 881449 | 47 | 67 | 0.26 | 19.7 | 3.77 |
| 935658 | 47 | 55 | 0.16 | 17.4 | 3.80 |
| 935696 | 41 | 70 | 0.18 | 16.9 | 3.55 |
| 935898 | 72 | 81 | 0.19 | 18.0 | 4.23 |

TABLE 176-continued

| Liver function markers in Sprague-Dawley rats | | | | | |
|---|---|---|---|---|---|
| Compound ID | ALT (IU/L) | AST (IU/L) | T. Bil (mg/dL) | BUN (mg/dL) | Albumin (g/dL) |
| 935928 | 189 | 188 | 0.19 | 19.7 | 3.59 |
| 935968 | 39 | 85 | 0.21 | 17.2 | 3.61 |
| 936006 | 40 | 55 | 0.14 | 14.3 | 3.97 |

TABLE 177

| Liver function markers in Sprague-Dawley rats | | | | | |
|---|---|---|---|---|---|
| Compound ID | ALT (IU/L) | AST (IU/L) | T. Bil (mg/dL) | BUN (mg/dL) | Albumin (g/dL) |
| PBS | 34 | 58 | 0.09 | 15.7 | 2.20 |
| 690890 | 32 | 70 | 0.16 | 20.1 | 2.39 |
| 690892 | 42 | 77 | 0.15 | 18.5 | 1.82 |
| 882085 | 68 | 73 | 0.09 | 47.1 | 1.36 |
| 882800 | 40 | 100 | 0.16 | 20.2 | 2.30 |
| 970527 | 45 | 80 | 0.12 | 19.8 | 2.09 |

TABLE 178

| Liver function markers in Sprague-Dawley rats | | | | | |
|---|---|---|---|---|---|
| Compound ID | ALT (IU/L) | AST (IU/L) | T. Bil (mg/dL) | BUN (mg/dL) | Albumin (g/dL) |
| PBS | 41 | 70 | 0.14 | 14.4 | 3.60 |
| 882408 | 38 | 68 | 0.15 | 17.0 | 2.80 |
| 1012795 | 25 | 70 | 0.09 | 22.3 | 2.47 |
| 1014095 | 37 | 101 | 0.12 | 20.3 | 2.41 |
| 1014393 | 41 | 70 | 0.09 | 20.3 | 2.28 |
| 1014394 | 32 | 74 | 0.08 | 21.1 | 2.53 |
| 1014834 | 34 | 68 | 0.10 | 14.2 | 3.04 |

TABLE 179

| Liver function markers in Sprague-Dawley rats | | | | | |
|---|---|---|---|---|---|
| Compound ID | ALT (IU/L) | AST (IU/L) | T. Bil (mg/dL) | BUN (mg/dL) | Albumin (g/dL) |
| PBS | 55 | 51 | 0.15 | 17.1 | 3.04 |
| 935762 | 35 | 53 | 0.14 | 18.7 | 2.63 |
| 935918 | 31 | 55 | 0.15 | 19.7 | 2.60 |

Hematology Assays

Blood obtained from all rat groups were sent to Antech Diagnostics for hematocrit (HCT) measurements and analysis, as well as measurements of the various blood cells, such as WBC, RBC, and total hemoglobin content. The results are presented in the table below. Modified oligonucleotides that caused changes in the levels of any of the hematology markers outside the expected range for antisense oligonucleotides were excluded in further studies.

TABLE 180

| Hematology markers in Sprague-Dawley rats | | | | | | | | | | |
|---|---|---|---|---|---|---|---|---|---|---|
| Compound ID | WBC (K/µL) | RBC (M/µL) | HGB (g/dL) | HCT (%) | LYM (/µL) | MON (/µL) | EOS (/µL) | BAS (/µL) | PLT (K/µL) | Retic (K/µL) |
| PBS | 10.38 | 8.15 | 14.80 | 43.9 | 8711 | 357 | 68.3 | 12.3 | 868 | 252 |
| 690898 | 17.83 | 6.46 | 12.27 | 37.1 | 15745 | 1109 | 75.0 | 145.0 | 214 | 201 |
| 881413 | 7.08 | 6.71 | 12.55 | 36.6 | 6342 | 286 | 44.3 | 15.3 | 523 | 152 |
| 881449 | 6.68 | 7.53 | 13.60 | 39.8 | 5414 | 396 | 153.0 | 27.5 | 583 | 133 |

TABLE 180-continued

Hematology markers in Sprague-Dawley rats

| Compound ID | WBC (K/μL) | RBC (M/μL) | HGB (g/dL) | HCT (%) | LYM (/μL) | MON (/μL) | EOS (/μL) | BAS (/μL) | PLT (K/μL) | Retic (K/μL) |
|---|---|---|---|---|---|---|---|---|---|---|
| 935658 | 9.73 | 7.97 | 14.53 | 42.4 | 8250 | 777 | 19.7 | 70.0 | 685 | 138 |
| 935696 | 7.80 | 7.33 | 13.10 | 38.6 | 6354 | 645 | 48.8 | 23.0 | 480 | 97 |
| 935898 | 7.75 | 8.64 | 15.20 | 43.3 | 6248 | 529 | 29.3 | 26.8 | 712 | 114 |
| 935928 | 13.15 | 7.36 | 13.23 | 40.1 | 7231 | 1177 | 8.5 | 90.3 | 476 | 160 |
| 935968 | 6.15 | 6.17 | 11.28 | 33.7 | 5292 | 436 | 8.0 | 68.8 | 462 | 178 |
| 936006 | 7.28 | 8.07 | 14.45 | 42.7 | 5875 | 729 | 20.3 | 57.3 | 621 | 220 |

TABLE 181

Hematology markers in Sprague-Dawley rats

| Compound ID | WBC (K/μL) | RBC (M/μL) | HGB (g/dL) | HCT (%) | LYM (/μL) | MON (/μL) | EOS (/μL) | BAS (/μL) | PLT (K/μL) | Retic (K/μL) |
|---|---|---|---|---|---|---|---|---|---|---|
| PBS | 4.35 | 5.18 | 9.68 | 29.4 | 3546 | 116 | 102.8 | 10.5 | 292 | 136 |
| 690890 | 4.75 | 4.84 | 8.98 | 27.4 | 3844 | 325 | 25.3 | 55.0 | 190 | 113 |
| 690892 | 4.70 | 5.46 | 10.65 | 31.4 | 3917 | 276 | 42.3 | 34.5 | 184 | 120 |
| 882085 | 7.18 | 5.18 | 9.43 | 29.2 | 5159 | 758 | 73.0 | 24.5 | 352 | 122 |
| 882800 | 5.10 | 5.08 | 9.13 | 27.9 | 4190 | 479 | 46.0 | 40.3 | 165 | 157 |
| 970527 | 9.60 | 6.10 | 10.88 | 32.4 | 7990 | 846 | 28.3 | 50.8 | 249 | 123 |

TABLE 182

Hematology markers in Sprague-Dawley rats

| Compound ID | WBC (K/μL) | RBC (M/μL) | HGB (g/dL) | HCT (%) | LYM (/μL) | MON (/μL) | EOS (/μL) | BAS (/μL) | PLT (K/μL) | Retic (K/μL) |
|---|---|---|---|---|---|---|---|---|---|---|
| PBS | 9.35 | 7.81 | 14.28 | 46.6 | 7820 | 330 | 208.3 | 11.3 | 344 | 214 |
| 882408 | 13.25 | 9.46 | 16.73 | 52.0 | 8387 | 1020 | 35.3 | 29.3 | 407 | 163 |
| 1012795 | 15.20 | 4.86 | 10.03 | 33.6 | 11767 | 1996 | 28.5 | 12.8 | 149 | 304 |
| 1014095 | 18.55 | 6.93 | 12.35 | 41.4 | 11958 | 1500 | 95.0 | 22.3 | 727 | 281 |
| 1014393 | 21.90 | 7.25 | 13.08 | 41.8 | 17709 | 2038 | 50.5 | 156.3 | 491 | 123 |
| 1014394 | 23.55 | 7.21 | 13.58 | 43.3 | 19656 | 2121 | 31.8 | 67.5 | 270 | 207 |
| 1014834 | 14.43 | 7.97 | 14.65 | 45.9 | 12543 | 1009 | 42.3 | 180.0 | 395 | 182 |

TABLE 183

Hematology markers in Sprague-Dawley rats

| Compound ID | WBC (K/μL) | RBC (M/μL) | HGB (g/dL) | HCT (%) | LYM (/μL) | MON (/μL) | EOS (/μL) | BAS (/μL) | PLT (K/μL) | Retic (K/μL) |
|---|---|---|---|---|---|---|---|---|---|---|
| PBS | 11.13 | 9.45 | 16.70 | 52.8 | 9156 | 686 | 103 | 8.0 | 82 | 238 |
| 935762 | 14.53 | 7.72 | 13.43 | 42.4 | 13586 | 510 | 0 | 29.3 | 92 | 232 |
| 935918 | 9.25 | 7.08 | 12.50 | 40.5 | 8509 | 456 | 51 | 5.0 | 92 | 286 |

Organ Weights

Liver, heart, spleen and kidney weights were measured at the end of the study, and are presented in the table below. Modified oligonucleotides that caused any changes in organ weights outside the expected range for antisense oligonucleotides were excluded from further studies.

TABLE 184

Organ weights (g)

| Compound ID | Liver (g) | Kidney (g) | Spleen (g) |
|---|---|---|---|
| PBS | 15.8 | 2.91 | 0.90 |
| 690898 | 16.9 | 3.18 | 3.65 |

TABLE 184-continued

Organ weights (g)

| Compound ID | Liver (g) | Kidney (g) | Spleen (g) |
|---|---|---|---|
| 881413 | 15.0 | 2.83 | 1.32 |
| 881449 | 15.4 | 3.07 | 1.19 |
| 935658 | 13.8 | 2.40 | 1.33 |
| 935696 | 12.6 | 2.60 | 1.22 |
| 935898 | 12.0 | 2.44 | 1.07 |
| 935928 | 16.8 | 3.23 | 1.94 |
| 935968 | 14.9 | 2.85 | 1.56 |
| 936006 | 14.2 | 2.75 | 1.59 |

TABLE 185

| Organ weights (g) | | | |
|---|---|---|---|
| Compound ID | Liver (g) | Kidney (g) | Spleen (g) |
| PBS | 15.2 | 3.38 | 0.72 |
| 690890 | 15.8 | 3.17 | 1.62 |
| 690892 | 15.2 | 3.27 | 1.72 |
| 882085 | 12.5 | 3.78 | 1.41 |
| 882800 | 17.0 | 3.46 | 3.24 |
| 970527 | 14.0 | 3.72 | 1.94 |

TABLE 186

| Organ weights (g) | | | |
|---|---|---|---|
| Compound ID | Liver (g) | Kidney (g) | Spleen (g) |
| PBS | 18.6 | 3.70 | 0.92 |
| 882408 | 15.1 | 3.60 | 1.51 |
| 1012795 | 18.9 | 3.70 | 4.06 |
| 1014095 | 18.2 | 3.63 | 3.05 |
| 1014393 | 15.9 | 3.98 | 2.30 |
| 1014394 | 18.3 | 4.41 | 2.79 |
| 1014834 | 14.4 | 3.35 | 5.01 |

TABLE 187

| Organ weights (g) | | | |
|---|---|---|---|
| Compound ID | Liver (g) | Kidney (g) | Spleen (g) |
| PBS | 14.6 | 3.20 | 0.88 |
| 935762 | 16.1 | 3.43 | 1.73 |
| 935918 | 18.7 | 3.89 | 2.01 |

Example 36: Tolerability of Modified Oligonucleotides in Non-Human Primates

Modified oligonucleotides described above were further evaluated for potency in non-human primates.

Treatment

Male cynomolgus monkeys were divided into groups of 4 non-human primates (NHP) each. Groups received a dose of 40 mg/kg of modified oligonucleotide by subcutaneous injection on day 1, 3, 5, and 7, and then once/week for six weeks. One group of NHP received doses of PBS. The PBS-injected group served as the control group to which oligonucleotide-treated groups were compared. After six weeks, NHP were sacrificed and tissues were collected for analysis.

Tolerability

To evaluate the effect of these antisense oligonucleotides on liver and kidney function, samples of blood, plasma, serum and urine were collected from all study groups on day 44. The blood samples were collected via femoral venipuncture, 48 hrs post-dosing. The monkeys were fasted overnight prior to blood collection. Approximately 1.5 mL of blood was collected from each animal into tubes without anticoagulant for serum separation. Levels of the various markers were measured using an automated clinical chemistry analyzer (Hitachi Olympus AU400e, Melville, N.Y.). Total urine protein and urine creatinine levels were measured, and the ratio of total urine protein to creatinine (P/C Ratio) was determined.

To evaluate the effect of the antisense oligonucleotides on hepatic function, plasma concentrations of transaminases (ALT, AST), Albumin (Alb) and total bilirubin ("T. Bil") were measured. To evaluate the effect of the antisense oligonucleotides on kidney function, plasma concentrations of blood urea nitrogen (BUN) and creatinine (Cre) were measured. Urine levels of albumin (Alb), creatinine (Cre) and total urine protein (Micro Total Protein (MTP)) were measured, and the ratio of total urine protein to creatinine (P/C ratio) was determined.

To evaluate any inflammatory effect of the ISIS oligonucleotides in cynomolgus monkeys, C-reactive protein (CRP), which is synthesized in the liver and which serves as a marker of inflammation, was measured on day 44. For this, blood samples were taken from fasted monkeys, the tubes were kept at room temperature for a minimum of 90 min., and centrifuged at 3,000 rpm for 10 min at room temperature to obtain serum. The results are presented in the Tables below and indicate that most of the antisense oligonucleotides targeting human IRF4 were well tolerated in cynomolgus monkeys. ION 935918 and 935968 were well tolerated.

TABLE 188

| Serum and urine clinical chemistry | | | | | | | | | | | |
|---|---|---|---|---|---|---|---|---|---|---|---|
| | Serum (day 44) | | | | | | | | Urine (day 42) | | |
| ISIS No. | C3 mg/dL | ALT U/L | AST U/L | Alb g/dL | BUN mg/dL | CRP mg/L | Cre mg/dL | T. bil mg/dL | Alb g/dL | Cre mg/dL | P/C ratio |
| PBS | 120.73 | 48.00 | 69.10 | 4.35 | 25.60 | 1.66 | 0.858 | 0.29 | 0.35 | 55.0 | 0.00 |
| 690890 | 71.20 | 50.18 | 75.20 | 3.66 | 26.10 | 9.52 | 0.988 | 0.23 | 0.53 | 56.2 | 0.04 |
| 935658 | 95.90 | 42.33 | 81.85 | 3.99 | 21.70 | 4.53 | 0.808 | 0.29 | 0.68 | 39.0 | 0.12 |
| 935696 | 88.58 | 48.32 | 62.78 | 4.03 | 26.06 | 6.55 | 0.780 | 0.26 | 0.18 | 36.6 | 0.04 |
| 935762 | 100.10 | 47.58 | 52.63 | 3.91 | 24.98 | 6.88 | 0.76 | 0.25 | 0.03 | 37.9 | 0.01 |
| 935918 | 94.45 | 49.45 | 79.20 | 4.05 | 29.85 | 4.65 | 0.90 | 0.24 | 0.12 | 60.2 | 0.01 |
| 935968 | 108.83 | 54.45 | 83.33 | 4.10 | 28.68 | 6.65 | 0.813 | 0.23 | 0.10 | 38.8 | 0.07 |
| 882800 | 100.83 | 46.55 | 61.80 | 4.00 | 24.10 | 2.53 | 0.818 | 0.22 | 0.36 | 34.9 | 0.14 |
| 1012795 | 82.05 | 37.08 | 51.40 | 3.05 | 27.45 | 21.28 | 0.763 | 0.20 | 0.50 | 55.0 | 0.10 |
| 1014095 | 85.83 | 38.15 | 46.85 | 2.81 | 15.10 | 11.16 | 0.593 | 0.15 | 0.03 | 43.9 | 0.07 |
| 1014834 | 89.13 | 54.73 | 75.28 | 3.88 | 23.65 | 7.03 | 0.978 | 0.25 | 0.14 | 75.9 | 0.05 |

TABLE 189

Body Weight

| Compound ID | Body Weight (g) day 1 | Body weight (g) day 42 |
|---|---|---|
| PBS | 2521 | 2594 |
| 690890 | 2508 | 2514 |
| 935658 | 2499 | 2557 |
| 935696 | 2412 | 2511 |
| 935762 | 2473 | 2653 |
| 935918 | 2483 | 2657 |
| 935968 | 2605 | 2798 |
| 882800 | 2577 | 2676 |
| 1012795 | 2623 | 2577 |
| 1014095 | 2567 | 2719 |
| 1014834 | 2556 | 2685 |

RNA Analysis

RNA was extracted from various tissues for real-time PCR analysis of mRNA expression of IRF4 as in previous examples. Results are presented as percent change of mRNA, relative to PBS control, normalized with NHP Cyclophylin A. As shown in the table below, treatment with modified oligonucleotides resulted in reduction of IRF4 mRNA in comparison to the PBS control with some of the treatment groups.

TABLE 190

% Inhibition of cynomolgus IRF4

| Compound ID | Bone marrow | PBMC | Spleen |
|---|---|---|---|
| PBS | 100 | 100 | 100 |
| 690890* | 98 | 119 | 205 |
| 935658* | 174 | 170 | 200 |
| 935696* | 71 | 80 | 125 |
| 935762* | 112 | 90 | 129 |
| 935918* | 98 | 41 | 192 |
| 935968* | 129 | 49 | 131 |
| 882800*** | 107 | 75 | 133 |
| 1012795* | 97 | 95 | 151 |
| 1014095*** | 80 | 80 | 188 |
| 1014834* | 139 | 180 | 192 |

*Compounds have one mismatch to cynomolgus monkey IRF4;

***compounds have three mismatches to cynomolgus monkey IRF4.

Example 37: Viscosity

Viscosity of modified oligonucleotide solutions was measured. The viscosity of 935918 is compatible with weekly subcutaneous injection, and the viscosities of both 935918 and 935968 are compatible with IV dosing.

TABLE 191

Viscosity

| Compound ID | Dose (mg/mL) by weight | Viscocity (cP) |
|---|---|---|
| 690890 | 300 | 16.14 |
| 935658 | 300 | 48.79 |
| 935696 | 300 | 120.2 |
| 935762 | 300 | 11.39 |
| 935918 | 100 | 2.12 |
| 935968 | 300 | 53.76 |
| 882800 | 100 | 3.4 |

SEQUENCE LISTING (3400 sequences)

SEQ ID NO: 1 - DNA, 5332 bp, Homo sapiens
acctcgcactctcagtttcaccgctcgatcttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaaaatcagtgacatctgattggcagatgagcttatttcaaaaggaagggtggctttgcatttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccgccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctccccaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgttaaaaaa

SEQ ID NO: 2 - DNA, 26001 bp, Homo sapiens
tctctggtataagtagcttagaaggttagattttttttttccagaggattaaacattcgagaagagtggctaagaggcagcaccaggtttctctcatttcctcaaagagaatttagccttgtgaagaagaataaagtgaaggtcaatggttagatccatggcttaaaaataaaatgcagctttccttactctgaatttaccataaccaaaaaggccacgaggcagccattaatgatcctaagttgcaacagaaagaaaaaaacacctacttagggttaaacgaggattcagtggtcacttgccgccggcctccacttcacaggggcggaggatgaggccagggaagactttcttacccacactgacctgaccagagatgaaactccccctcctatgacagcctgcactcagaggctgattctgaaatagtcatgccaaatgcagccaatccctgtgtacaaggagaaaaaatagttcctcagagctgtgtccttgggccagccatctggacctctcacaatctctttcgttctccctacacttgggctgaatcccgccttccttgcctgccaggtttggtttgggggccaaatgagtgaaagtccgtgagatacccctaagtattgaagtgcgtagtaaatgataatagccctgatttgttgaacatgatgatgtgccaggcattgcgcaaagcatcatttcatcatcacaacaaacactgctgggaggcagggacacccccaccctccttgtacacccagaagtaggactttggttaaatggctctcccaaggcctcacagccttaaaaactcaagcacttatttaatccccaatgatactaccttttggccatgcaatgtgtcatggccagtaattagatttgcaaacacatataaccaaagaggattagaagagacatatattctatataaattacatgaaaatagcactttcagtattttcctgattttttctggtaattaaaaatgattgccctttatatttctttatggatacagttgcattgtttttagccaattgtagcccccccctttaaagagtgaattagtgggaaaatagtgttatccaagattttaagaatctagtgtgtgtgtttgtgtgtgtaggatgggtttttctgaaatattttacttgcatgtgaatgtataattttaaagattggcttttaaaatactgaattgaggtaaattcagcttttcttgcagactctttacgataaatgtgaaattgaaaatggaaatgctccattcagatggtgtgccgactacaacctcaacatacggataattcactaaataagtaacttcctcgtggaatatcacggtcagcctttgttttgggtacacattcaatgaactggtttcctattagtttctgcttgtcaacaagttgtgtcatttactgataaatatccagccttttactaaggaataccgattttctcaagtctcagtgtgtggagggggtgggagtttggtggggaagcttttcaatttgagaacctttgccgttttttgtttcaatcgtgactaagatataaaagtccttggtcaccactgccagctgctacctgttcactgcctccctgacgggtaatgaggccatccggagttttagtgattaaaatgttttattacttgtattcacatcatcattaagaaaaataacttctagtggatcaatatggcaaatgagtaaaccagaagatggcgttgaagattagcaattacatttaaaaacaaggtagtggtgtgaaggctcagagtttcacacaacgactgttgttctgaactaaaagcagaggatgtggatgagtgaggggagggtatgttgaaaatgactaaacccggtgcagaggacacgtatacgaaagtgcaaaaagctctcatttgccattttttgtcctcagcaaactcctctctggtatgtttgtgaacgtttgagggaaaggtaacactgattaaaatataatgcaacaagaaggcaacgatctttgctttgttcactgatgtgttccaagtgcctaggacggttcctgacaagtagcaggtgctcaaaatacatttgtcaagtgaataaatctgtgaaaggaaaggaagaaaaacaggttgtgaccagaactttttgtgaacaaaaccctgttgtttattacatagactttggtaatggaaaacttacttgggtgaaataaaaaatggcatcctgttaatttctgagaacgtctgttggttttaggaaaagcatacctatccatacctcactacctgttttgctctagcctaaacatagattcttctttggttaggagacattgacccaatatataagattaaaacaaaaactgagaaataagtgaaatcaaaagcttttcaaaagttgcaggttgacctacggtggtggtggtctaaaatcatatagaaaccagagatctgatggtttacctgaaaatgcgaagtaaatgcacatactcagcatctcagacgatcgaaagctcaacgggtgaaagctcagggggttaattttgcgattaaggacatcttggaaaagtatgtaaaatccctggtccacttaagtattattcctattttgggcttttatttatttattttgagatggagtcttgctctgtcgcccacctcggctcactgcaacttcagcctcccgggttcaagcgattctcgtggctcgtcctctcaagtagctggggccacgcccggctaatttttgtatttttagtagagatggggtttcaccgtgttggccaggctggtctcgaactcctgacctcaggcgatccaccgcctcggcctcccaaagtgctgggattacaggcttgagccacagcgcctggcctattttgggcttttataccccactggtaaactgctttcctccaggttgaggttaaaacgacatcattttaaggtgaactgaagtctggaagtgattaagcacttggatccttagggagcctctccccgcccccatctctttcatgctaagataattaaaacttcggggccggggcattgtctgagtcacttcaattcaccagcctaatagatgcaaaaggatgtaagcatgtcagacacgcagagacagtatttgaatcaagcttaatagctcaagggagctgggccatttcctattttctttttagtgagtgcgatgttctctaaacaccgcggagaggcagggttcccggtgatggccttgccgagggtgctcccgcaacctccacctccagttctctttggaccattcctccgtcttccgttacacgctctgcaaagcgaagtccccttcgcaccagattcccgctactacacgccccccatttcccgccctggccacatcgctgcagtttagtgattgactggcctcctgaggtcctggcgcaaaggcgagattcgcatttcgcacctcgcccttcgcgggaaacggccccagtgacagtccccgaagcggcgcgcgcccggctggaggtgcgctctccgggcgcggcgcgcggagggtcgccaagggcgcgggaaccccaccccggccgcggcagcccccagccttcacgccggccctgaggctcgcccgcccggccggccccggctctcggcttgcaaagtccctctccccagtccaacccccggcccccacaggcctcggcgccccgccccgccccaggccccgccccagagagttctataaagttcctctttcccacctcgcactctcagtttcaccgctcgatcttgggacccaccgctgccctcagctccgagtccagggcgaggtaagggctggagtcgggcaggaggaggggtgtgaggctgataccagagaggacccggagcgcgaaccagaggttcgacctccagggcagcgcagggtaccccggcttcggagcgggaagggagcgcgccccgtcctggagctccgactcccaccccatctgcgctgagccggaggcgctggtttgggctccaaggcccgcctccttggctctgcccgagcctccccgcctgccctccgcgctcctgcgacggggtcgccacaagctggacgggatgagctaaccggactgtcggggccccaggagtggctgaggcggggccgtccaaggcacccacacaagacggcacaactgcctgcgagaaacaggcccggccctgtggaccccaatccgaggctccttcccctgctcttcgttcctaaggggcccaagctcacggcggcctccggcgcggtgctcacccgctggcgcaggaggaggaggagctccacatttgggtcgctccgagccttgcgtgcggtggcctagccggcctggcgcggtccctgcctcccaggctccgcagctgtcgtcgccctctcccgcgccctccccgcctccgctctcccgggcctgctccggggtccggcggacgctctgcgcgcggaatcccccgtactggggctgcagcccccgcgtctgcgccacttgtcgtttgcagagcccacttagtgcgcgctagctgggcagggataggggtcctattcggggcgaagggtctggatgcgagcagagaaagcggagggtggaggaacccggggctgcgcccctggaacgcccggccgcaggcgaggtcctccgcgcgtggaggccgccaggggagtggaaactgacagagtcgcggggaaggggcgagaagcgggttgggagtgagcgaaggcaagcgagagctgcgagtgagtgcggaaggagggccaggaggggtggcggctgggtggggagagagggtgcaagacgagcggcgcgtgtcgggagcctttgggctgcgggtgcgttacaggagagcaggcgggtaggagccttcgcgggggccgagctcggaaggcggacggctgtgcccgcccaggggatgcgcccgggccggccgcgaaggtgccttcttccgggggcccggacgaccctgacacggcacgcgcgcgcttcgcagcctcaaagactccggggcctcgtggtcactggcgcaggggatcggggcggggtgcccggagtgcggtgcctcgtggctgaagggcagctcttctccccgcagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggtctccggcctcgggagccggcgggggcgcgccggggagggcccagagacagagcccggggtccccggcgccgcctccgaggcgagcccaggggaccgcgcggggcggacgggcgggcggcggaggcatcaggtggcgtcgccggagccgcaggaggaggaaaggaggcctcggctctcagcgggaccgcgggggccgggagccgggtcctgggcgcgtggaggctgcagggaaaccgctgaaggcccggccgggcccggggaagggcggccaaaggcttgaggggttttgcgcgttcgtccgtgcgttctcgtttccacgcaagcctcccgcccttcctccgggctcccgtctgccgcctccgtccgtgggtccccctcgccctctccgtgcgtccgcgcctgtgccggcggctgttttcgtctctcaccgcgtctctgtttctcttttcgctgcttttctctctgagtctctctctctccatgtttttcctgaggtcagcctctcttctcgctcctgctagctctctgcgggtactcccacctctgtctttctctttgtgtgtctctgtctctctctttcccccatcgcagtggaactcagggcctctgtctagagctgtctcccttgccctttgcgcgagtgcacacacgtgtgtcgttgttacgattgttctcccctaaggcagtttacccagagaactacgtgtctgggcccagcccccacctgtgggcagagcaggggaaggggacttcctccgggaatttggtctcaatttgctctcagagtgcctcagctgtgctgccatccagatgtctcctgtgggtgacagctcacaccacagctgtccttagtcctaggcaagctcactcagacactgggtgggtagagccccctcaaggaacctccgcatctcactctaccggttataaatacccagaaaatgtgtcttcaacttggcagtgatagggtccaagatggaaaatcattttcctagagcatagctggggtctttcagtttacgttctgagcaacggtgtaaatctgaaggacctatgcgccattctttcttttagaaatacaatttcaagattccttataaaatatctgtattttgggtttagcatggtggctcacacctgtaatcccagcactttgggaagatgaggtggaaggatgcctatgcaacatagtgagaccctgcctctgcaaaaaataataattaaaaaaattagccaggcatggtggtgaacacctgtaggccgagggcccagctactctagaggctgagataggaggaccctagaactcaggagttcgatgctgcggtgagctatcatcgtgccactgtactctagcctgggcagcagagcaggactctgattccaaaaagaaagctaataaaccagacatgtattttgacttttcgttctcttcattctttcccaccaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggtaggggctctcctgaatttgggtcacctaacagaggcagccagatccttgaggcaccttaacttcattctgagcatcactttctagctttccttttgtattgcctgcctgcctgccttctgcctcacagtgaagcccagcctccttgcctgagttatgtgggtcacaagttgaaattcctgtggggttcagcataggagaattaatcacactgtatgcctcaatgtatatgggggggggtgcattgaatatgtgttttccagttagtctttcaaaaaaaaaaagaaaaaagaaaactggataacttgttaaaatttacttatctaatagtctttagtgagtgactattttgcagaaaaggagtaatgagaggaatatctcatcactatgcatggtaataaaactgtcaacttttaaagtgtaacatggtcagctgaggtgtttattaaaagtcagattcctggacccctcttttcaagattctgaccagtgtgtctggaagagagctcaggaatctgcatctggaacaaatccttcaggtgacctcacttgggaaacatctggctggcggggtcctttatgtcacaaggcacattcgcatgccatctgtcatgtatttctttacctgtcctgtacaactcagaccttgtagaaaaaaatcagtttaatagcatgaaaaaataacttcccaagggagttgctgaaaaataccttatttgtcaacaccgtgttatgcattctaagaattaaatgctcaggtatttttacaagatttgacatttagttaggtcagttcctgtttttacgttgtgccatttcccttttccccaaacatgtaggagccaagcagctcaccctggaggacccgcagatgtccatgagccacccctacaccatgacaacgccttacccttcgctcccagcccaggtatggtggagggcactgggctccctgagggcgaggctgtgtgggccagctgcccacatggccagagaaccacagcagcccagacagcagaacttgccatttgctatggctgctccaacagcccagaaaaaccccaggtcactgaacgaatgtctcactttccacacggtgctgccattggtgtggattttaagttggggagggtcgggcgtgtccgcctgttggaatatgcttctcaggtcttctgggaaacagatgttttgtggaagtggaagattttggaagtagtgccttatcatgtgaaaccacagggcagctgatctcttcaggctttcttgatgtgaatgacagctttgtttcatccactttggtgggtaaaagaaggcaaattcccctgtggtacttttggtgccaggtttagccatatgacgaagctttacataaaacagtacaagtatctccattgtcctttatgatcctccatgagtgttttcacttagtctgatgaagggttcactccagtcttttcggatgataaaatgcttcggctgtcagtctaataagggattccctgaggagtttggaggctgtaagagcaccccccgtctcaatgccagtgcttcttatctcagcctctcctgcactcctttacccccgtctcgatgccagtgcttcctatctcagcctctcctgcactcctttacccccgtctcgatgccagtgcttcctatctcagcctctcctgcactcctttacccccgtctcgatgccagtgcttcttatctcagcctctcctgcactcctttacccccgtctcaatgccagtgcttcctatctcagcctctcctgcactcctttaaccccgtctcgatgccagtgcttcttatctcagcctctcctgcactcctttacccccgtctcaatgccagtgcttcctatctcagcctctcctgcactcctttacccccgtctcaatgccagtgcttcctatctcagcctctcctgcactcctttacccccgtctcgatgccagtgcttcttatctcagcctctcctgcactcctttacccccgtctcgatgccagtgcttcctatctcagcctctcctgcactcctttacccccgtctcaatgccagtgcttcttatctcagcctctcctgcactcctttagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggtaaggaggataccagtgcaggaaatagaagagctaattgctaatgtggccatgggccatggcgaatcctggtctgtcctgggcagcaccaaagctctttccccttcttagaggctgcgtgtgcagctcggggagaggggggttttctcactcctgtgggatggtggcatcccacagccaagtttactctcaggatccatgctaggcactgcccttcgtgggatcttatttaaacaccacagagatcactccaggcagtggaaaacagccccccactttttatatagagaggagattgtggaagctcataaataataagtagggatgctgggagattattgagctggtatatttctctcgaatagtggtgtgttcattgttgctattgttggaattagaggtgatactaaaaaaggaacggaaaaataccatggcaaacacataaaacgtctctacaggtgcctacctaccactgggtcccagaaagacttgctgattgtggattagatgtggtcccctgccctcgggagttccccagacatcaaaatgagctccctcagcagaagctctcattagctgggtgcagggagaatctagcaatgcggtaactcaggccttcaggacttttgagttagttacttaaatggaagtcctgagacaggtcaacacactgaaccctttggatgttttaggaatatttgttcctttgcaatttggcctttttttccccagtcatgttcaggttatccttggctgcaggtagtgaagaggtgtaccactctttaatgtttgtactgagtggcatgttcacaaaaaagctcagaattcagttgcattggcttttcaagagggatttgcagcaagggctggtttccaatatggtagtggaggaattggctaacataaaactagctcctgaaattcagacttgcgtttactgctctggctctatggaattagtaaccatgggaaagaggcaatgcttagaactgtgtaaagtgatggagtaggtagagacctgtcttgaagcatcggtaacagtaaatgaagcagcagcaagatcaggtgttctgtgccacattctttttccattcatgtttcatacaacattgtcttcaggaacatggttcagtgttctcccaacccacaagagacaagcaaaataaaaatggactaaataatttgctagtttttaattgggctctttggcacagactcaagtagacctgaactctcagctctgttgtgaacccgctttgtgaacaaggacaaagcatgtcatctgtctctgagcctcagtctccctgttagtcagttacagagagagcgctccaagtttccttccaaagctgtgcactggctcgtttctccatcagctttggttttccagttggtctccagctcatctttgcctcacaagagcgtgccctgctagttgctggtgctgggagtgggtgggaaggtgattgggcgccagccccttccttcccaggcttcacacacacaccccaggaagccccgcggtgcgtcggactctctgtctagacatcatctgatttttatttgcaaatgcaggttgccaggtgacaggaaccttttatgcttgtgccccacctgagtcccaggctcccggagtccccacagagccaagcataaggtctgccgaagccttggcgttctcaggtgagtgcagggtttgctcctggaggcaccgcaggaggccagcctctgctgccagctctgtcatctttgggcagattcgatgggactttagacacttgctttgctccctctggggtctggagtagatgtagacacatcctgtgtgtgaggtgaccagggtgatttaggagcaccattagaaaacctgacatcactgcttgtggttctgctgaccgtttcagccactggcttgaatggagtcattttggcttcttcactggcacctctctgaatttctaggaatgtgcctttacctttaccgagggcccctcttcagccaacattctcacgatgtggaataattgcttggaagtgtagaagggcttctcattttgagaagctgatcatccttccaggttgagccacaaataagtcctcctcctctactccctggggacattagttctggtccctcatctctaaaacattgatgtgcctaagagtaatacacattttggtcttcctctgaactttaatatagcttgcaaacaaatatggattcaatctgatttttaaagttttatttctaaaaaaaaaaaaaaaatccctgcaccatggagatcttacctactataaagaaggcacctctaggcttggcaagcacacgtgctatatgtatatttatttttcagataatattttggattgtttttaaatgggatttgtttttatattaaaaccaaatagcttaaggtttggaattctcatcttgccctctggcatctttaaaaatcagtgatgaaaaatactaactaaattctgaaggtttcagggaggcgagagttgtggcacttttgctgctcagaggggagctggagtttgacctaccagctctttctagttgtgaatgaggcttgcacctttttttctgaggtgctcgtgagtaactgaggatgccctttgggaggaggtgcttctgagcaggaaggcttgtgtttgtttttagaaactttcaaacccttgtcttgaacacctaagacttgtgtgggtgcctgaagagtaggaaataaacagctatttatatctcggcaacctcgtgatttctgatgacattaaatgaaatgaaacctgccccgagaatcacctcgaatggccaacacccactctctttggggcgcactgtctgactcgctttcagacagtgtgttgaagcagagaattgagacagtgatgtgggttaagtctcaaaacctgctgttgaggaataagatagttttgtgggtttctttttttggtatgcatgatacagattaattatcagccatgagcacatttattagataactgtgattcccattgattttggggttccatacagttaccagtggcagctgcctcctgtctgtgccactcccctgcggtctggctgaggagcttgtgcaaacccagcttggttctttcaactcatgggcgatattttaaagaggcttctgaaatcagcaaaacgtttgtaaatggattcatcttgtttaaagtttcagagagcgcagttttagagttcttttcaaacttaaacacaaagcccagtgggaatttcagcagactttacatgaacttttagagtatttttctcattaatttctttcttttcacaagaattaattttgtgataaaaacaccacatatccagtgtggaaaactaatttaaaaatcagaaaaacaaaaatggaaaataaaaatatcacattctaccacccagaaatcaccattaaggcctcagtgcttaccctttaatgtgtgtatgtgagtgtgtttatatataaattatatagacataaataattaagcacctaattctatatataatttatatatgtacacacacacacacacacacacacatttgctttttacctaaatgatgtcatgttattattttggggacgtttcaggtatgtggaccgacttgcttctttctgaaacaccgttatattttttgctagtataaattaaacttagggttcatttcctccaaagtaaaaattgatttgcttaaagatgaattttcattcagtgacacatgacttaaatgacatcaccactatcatcatcataattcacaaataagacttagcaagttcttaatagtgatgctctataataggaattcaacttacatttccagaaaattaatgaaagatacacttgttccttaaaaaaagagtcggtggccacatacgtttgtaatatgctggtttagacagattaaatgggtttctttccacgggacttctccaagtgttgaccgagctcatgctgtctgtggatctctgggggagacaagggcacgctgtgtttcccaggcctccttgacgcgggaaccttttgttcccccacgggacatgtgggacactagagttccaccacaggtgcttggctctgtggagtcgttggcctcgaggtggtgtccttggcccccagcactgactccggagctctgtgtttgcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcaggtaaggcacctcgttatctgttagaatggaggtggtgatggcctgcctgccacaggggtcagaaaccacagggtccctcccaccccaggctgaggtcttcctcctgttgacttcggcgcccactgggcttggggcttgactccagtagagatcttctgtctggctctgttgtgggcagagagtccggatcagatggtccaggtggaccatggctcaggctgttctcttgcaattctggttttcagcagtcgcctcttaaaacagttccatttcattgcactatgatctcgacaaatacgtctgctgatgtggcggctcttttcaggttcccagaaaaatcataaaggttggaagcatattgttaacattcttggttgtcaggtgtgtcaccctcatgcagatgctggcccacgagtgagacggagggtggagtggactgtactggttttgcacaggagaagttataggagagtgctataagttggctctgtgatatgaacatttctaagcatatttttcagaaccagtgagttttgtttttctaccttggatttcatgacaattcagcgaacctctggctggcttctgtgaagcccctcgccctgtcatgctgggcttcctcactggctttgtggggctgtccaggtggagggagcctcccgcgtgggagggagctgctctacccgccactcgccaccccaccgccaactcttcctctgccttttcccagtcctgtcccttcctgagccccttcagaaactcctgtgtctttgatttctcatgtgcctccccttttcttgaatgtgcttcttcattcaacttatttaaaataaaaatatgacacgtctgtgtgctctggcactgttgacatgtgctcgtacttctgggtgtaagtgacccaagtttttgtaagctcatccagattttcttttggtgcccaaagcaaatatgtccccagataactaagcttcaggccaggtgtggtggcccatgcctgtaatcccagcactttaggaggctgaggtgggcagatcacttgaggccaggagttcaagaccagcctggccaacatggcaaaaccccgtctctactaaagatacaaaaattagctgggcgtgatggtgggcgcctgtaatcccagctactcaggaggatgaggcacaagaatcgcttgaacctgtgggaggcggaggttgcagtgagctgagatcgcaccacggtgctgcagtttgcaggacagagcgagactccattgccccccgcaccacaaaaaaataactaagctcacacagaggctgaccataggaagagggagaactgtgctggttccccgaggcggcggcaagtgaggaagtcacctggggctggacacctctcattctaagggcagaaccatccccaagccctggccagggcggtcccatccttcttggggttgggcatggtgttcatgggggaccaaggaaattgaagggcaactggggggaccccccctcccctgtcagcatctcctgtgtctgccttgggatctggaagagctcacatgggccaggaaggctaaggcccactgggcctggatttctgaagactctggaccttggtgccagtggattcagaagataccacaaggtgagggctttctaatgaaagtgtcacaaggaactggcactggcttttctgagtgcctcttgctgggcgtttttagggaggtagagcccccgtggtgactaagctggaaggtgcacattgagtcacaggtgcactgcgtgagagacagcacaggcagggggtggacgcctgtgagtgtcctggggctgtagacttgcgcgactagaacttactattaatctgtgagcaagagctggtcttggctttcattccttcctctgtaaccaagggctgtgctctttgcccactgcagcctctcacctcaaagtgttcactgaggttcaaggaggatgctgtgaacgtaaaaactgcagctgtgccaaccagcttctgcataattaaggattcccaccaaacactctcatgttatctagggttggagccatgctttctcagagaattgtgccaactcgccattctgattagcctgtgtaggtgtagtctcagatcacggcagtgtgaatgtattttacagattctgactaagtcatttgggtttgatttgaattctggaaaaaaaaaaaagcaggaagtcaaatagtcctgtaagttagctagaaacttctgttcagttgaagagaacagtggagatctttgatatcttcctattcaggtctgcacagcactagggacagcccccagggcccggcccgagggtgtgtatctgataaggacgcgtctgttctgcagaagctgtagcggctcctgtgtcaactcgtttcttttgcgggcgtgacattttattgtagctacaggcagaagatttgtcttgtgtacaggggagggagcatgggctaaagtcaggggatgggcacttgtctttccaacaatgttccagtccgttttgtatcttttgggtaggtgtggtggcttcaggatgtacatgtgtatatccacaagcgggaggccaggggggctgccccactcctgttctcaagtcaagttactgttccatccctggagacaggcaagaagtctactcagagttacacagttcaggcatagtgacagtgggactcagctgccgatggctggtgctcagtcaccacgttgacgttacatattttctgtggtgcctgagttacgtggatgtccgcagtagcacagatactggattatgtgggctctgtagtgaggggatgaggttttaaaatgatcctgggatgtcgaaacattctgattttttaaatgaaaacttgtccatggcataaattggtcttttgccattgcgtgactacgtttcttgttctttatctcccgacttcactgtggtctactaccttttgaatcttcgtgggtccaatgctgcaaagcagtgttctttagctgtcgactagttcctcttgaagaatcgagggagaccgagggccctggggggaaagcacccaaaggaatgcatacatgctattttgtatctgagatgttcacatcaagagccccactcagcggagtaagagtgctcattcctcttgcagtgttcagaatcacagtaagctcttgcttcctgtttaacctggtgtgttcggtgatgagggtttctgaacatggtctctttcttgtgggcttctacagagctgcaagcgtttgctcaccacggccgctccctgccaagattccaggtgactctatgctttggagaggagtttccagaccctcagaggcaaagaaagctcatcacagctcacgtgagtcctcagttacactcctaccatagtggcttcctgttctttgtaaaggccagagtttcatttagaaaagtcccaaatgaaaagtaaatgtcaaatgacctggaaaaataagcgtaacccttaaactagtgagggaggaagcatggtccaacgagcagcacagtctgaggactcacgtgctcctcccagacttgagatctgctcatcaaagaaccagggaggacagcctcaaaggagggtgcctctttccccatcttttttatttttcaggaaagttgtcgtatttccattttatagggattgaaaaagattgatggttaaagttgccctttaaaattctccaggttaagattgctgtaagaatgctatctagctagtggatcttcattcaatggaaaagcttttcccaaatgagaaactatccattccctggaggcattttgtaggtctctgcagctgtgtcctagcacctcttttatttctggaattttagaaattatttaattattgggcatatgatatttgaaagaggctgaatctttcaaggaattcaagcaaatcagaccctctcgtaatgttctctagcatagctcaagatgggttcaactgtggcaagtaacactaaaagggtagggttaggattagggttagagttttcttttttatgagaaaaggtttccatagataacatgaagcattaatttgccatgggaaacagaatcttgaacccttaagacttttgaatttgaaaacttcacattgctacatacttgcaagcattattaacgggcttgcatgctgagcaataccaggtaaaagttacaccccctaacatcaaagttctcatcatgttctagctctgatgctatttctcattgagaactgaaatgaaacatggtttaatcttgaacatacaaccccccttcttgattttaaaaacaaagaccagccaaccaaccagtatataatcccatagactcaggagttttctcatgagttctctccagtgattgacttaataattgatatgattgttgaaataataactgatacattgttaacaacaggaattgctaaatgactaaataaacttggcattgataagcagcatttaagaagttgatgatcggccgggcacagtggctcacgcctgtaatcccggcactttgggaggctgaggcgggcagatcatgtggtcaggagttcgagaccagcctgaccaacatggtgaaaccccctctctactaaaaatacaaaaattagccgggcgtggtggtgcgcacctgtaatcccagctactcgggaggctgaagcaagggagtcacttgaacccaggagtcagagcttgcagtgagccgagattgcaccactgcactccagcctgggtgacagagtgagactctgtctcaaaaaaaaaacaaaaaaagaagttgatgatcagctcagctatcacatcaatccagttttaaagttgacatggatgcaagtcactgtcctctaagtcagggaaagatggatccccagatgaccccctcatgctgaagacgaggctgcgtggtccataaaatgaataaacacacgtgtacacctatgagttccacttttaaaaattattaatttaattcatttcaggtacttaggagtttagcttaagtcgtcatatataaaatacagtctctaatatcatgattgatggagagcattcagcttgccttagatgctgtaaattcaggaaaagctgaacattaaggcgtttttgttttttggtgagtgtgatccacgctaataaccagacagtataaatttgaggccagttagcttctctttttccacaatagtagttttgttgttgtttaactttactttttatttcttttacctctggttgagaactatacagattacctagaaatcaaatcattcaggatgagctccttgtttctttcaaactgcagttgtggaaaaacaaaatcattggcctaaattaccctgcagattccctcagacttccttttaatttgatcactttacttgatttgatgcagttttagttaaatgtacattttaagtggcagtcgatttgaaagtaacatctttaacccagaattaagtcactttggctgtttttttacatgttgatctatggaaggactaaccaaaaaattgcttctttagatggctccaaatatgaaatgttttgatgtgttctaggatgtaactttgggctttacgttactgtctccttagaatctgagtgctgtttaatagtgagccagttgcaggatatctcagtaatgtctttttaaaatctcttattaaaggtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaaaatcagtgacatctgattggcagatgagcttatttcaaaaggaagggtggctttgcatttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccgccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctcccgaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgttatggaatgtgtgtgtgtgttattaaacatgcatcctgatagcttttaaagcactttctcctgcggttacgttccttcagagaggctgctgtacgtgtctctgaaatcagatctccaagtgttcaccttgttaaagagacaaacgctggccaagtgccgggctgctcctcccacacagaggagtgtctgtgaagagtaatcatcctgctctcccgttagcatctgcctcctcttcctttatctgtactttaaaaggtttagggctttcaaggaagttgtttttaatgttttcttttgtttatattcgaagctcctctgattttggtcattgctaaaaagaagggatataggttaactaacactccaaatgtgaaaatcaaatggaaaactggataaagagaacaggatttagatggaacccctggggatccgtacgtctgctgttgacctcagctccaaactcttcctctctctgagcagccaggcaagggagtctcctttctcagcttcatcgcttctactgattacatggctcagctcctatgcacctactaacttccagtccagcagaaaaactcaaagaaccaggctgcagctgctggtgctaaaatccttgcagctgaaggttacatagagctgtcagaaaagtttgtagtttggatctagaaccccccctagaatagtagattagcataattttgattttgctaaatggtaaaatttcttttctaaaccctcacaagttcagttgagaaactttcctgaaaacaaagatcaataaatcttagcatagtgataagacaaaggagacagcagctccagtgttttaaaaggggacaaaaatgagagaaggtagtaaaatctgttcccagattccactgctgccttcgctgttcccaggaaggaaggatttatgtcctgatctcaggagacaggcttcagcagagtgcttccctgtgagttctgtgttcctaacttaacaattctcaatattttggggagaaatattttggtttccttcagtccccccttgaagctttactttcagaaagtttcacatgttaaaagctaagttggtagttttggagagatttgggttagaagttttaagataagagatttggcaaaggaggaggagaacatagtttggaacaagcagaaaggaaccaatttgggtacattgttccatctcttattgtatcagtctttcagtcctgaaaataggtcagttccgttaaatcattgcatcccatttcagaggtggtgtaagtgggcttccataagagttacgtcttccatatggtgtaggcacacaggtactttatcagagacatttgtatggaaataaaaagaaaacaaaggtctatgtttcaagcagtctataagctagtttctggagagcaaccagctgagatttctagatttgggttcaaataattttaagttggagtggacaggcagtggcaatctgacagatttttctggattatagtttgcatcagacgttccagtgaagtttttgtccataaataaattgtgatgacttctccaaagtttatatcaagttgttcagctttcatttgcagggcttcaggaaaggcacggttttaattcctagtgatttcaagtcagaaaggtgggagaaagttgggaatgttagtctgaagagccatagcagatattagaggaaactaaaacttcaggattcagtccagataatttttaaaaactctaaaacaatggacagggctagaatctaataacagctatgctatagctgttctgaaacattttttctctctacagtcacctccctgtttaccaaagataatcacaataagtccagtttacttacaaaacaagtttagtgtcattatatttaaccggatcatttacataagtacagcaagaacagtgatttaacatataagctctttttaagtcagcgttgctggaacttttcgtaaagaattttattagattagaacactaaaaccctcttcagactaggaagccgtgccacagacttaccaacagattttatctgagatacctgggtaaatttttttcttgaggtctccaaaatgttttgaggttcctgggcttgtcagaaaatgacattatttacttactgcaaggctagaagtgctggaagggcaccgcatagttcaggaacaaagtgccaggccagttctttcaagggttttattggctccttaaagttaacgttcattcctttaagcagtctggtcacatctgaaaaaatgacgtcccagtcatagccttgatgatataacctgtgtttccaatttttccagtccgaagagagcagattcctagtgaacttatgcaaataactatcttgccataaaaatagaatttctcacatacagtttctaaatcctggagggctcaggtaaagaaaaagataaatgtttcaatatttgtgcacaaaaatatactttacaaaattactgtaaagctgtagattacttaagagggaaaaaaagttttctcaactatggaaagaaaacataaaaagaatcagcaatgctttaa

SEQ ID NO: 3 - DNA, 20 bp, Artificial sequence
  Synthetic oligonucleotide
gcagctcaccgcgctcatgc

SEQ ID NO: 4 - DNA, 20 bp, Artificial sequence
  Synthetic oligonucleotide
ttcccgttgccgcagctcac

SEQ ID NO: 5 - DNA, 20 bp, Artificial sequence
  Synthetic oligonucleotide
agccactggcggagcttccc

SEQ ID NO: 6 - DNA, 20 bp, Artificial sequence
  Synthetic oligonucleotide
tgtagtcctgcttgcccgcg

SEQ ID NO: 7 - DNA, 20 bp, Artificial sequence
  Synthetic oligonucleotide
tcctcgcggttgtagtcctg

SEQ ID NO: 8 - DNA, 20 bp, Artificial sequence
  Synthetic oligonucleotide
cccaagccttgaagagcgcg

SEQ ID NO: 9 - DNA, 20 bp, Artificial sequence
  Synthetic oligonucleotide
ttgtcgatgccttctcggaa

SEQ ID NO: 10 - DNA, 20 bp, Artificial sequence
  Synthetic oligonucleotide
ggtccggcttgtcgatgcct

SEQ ID NO: 11 - DNA, 20 bp, Artificial sequence
  Synthetic oligonucleotide
tcaaagtcattgctcttgtt

SEQ ID NO: 12 - DNA, 20 bp, Artificial sequence
  Synthetic oligonucleotide
agttcctcaaagtcattgct

SEQ ID NO: 13 - DNA, 20 bp, Artificial sequence
  Synthetic oligonucleotide
tcaaccagttcctcaaagtc

SEQ ID NO: 14 - DNA, 20 bp, Artificial sequence
  Synthetic oligonucleotide
tccgctcaaccagttcctca

SEQ ID NO: 15 - DNA, 20 bp, Artificial sequence
  Synthetic oligonucleotide
tgtacgggtctgagatgtcc

SEQ ID NO: 16 - DNA, 20 bp, Artificial sequence
  Synthetic oligonucleotide
tccagggtgagctgcttggc

SEQ ID NO: 17 - DNA, 20 bp, Artificial sequence
  Synthetic oligonucleotide
ggctcatggacatctgcggg

SEQ ID NO: 18 - DNA, 20 bp, Artificial sequence
  Synthetic oligonucleotide
tttccgggtgtggctgatcc

SEQ ID NO: 19 - DNA, 20 bp, Artificial sequence
  Synthetic oligonucleotide
gacattggtacgggatttcc

SEQ ID NO: 20 - DNA, 20 bp, Artificial sequence
  Synthetic oligonucleotide
ctgggccttgccagtggtgg

SEQ ID NO: 21 - DNA, 20 bp, Artificial sequence
  Synthetic oligonucleotide
tcacaagctgggccttgcca

SEQ ID NO: 22 - DNA, 20 bp, Artificial sequence
  Synthetic oligonucleotide
cattttcacaagctgggcct

SEQ ID NO: 23 - DNA, 20 bp, Artificial sequence
  Synthetic oligonucleotide
tggcaaccattttcacaagc

SEQ ID NO: 24 - DNA, 20 bp, Artificial sequence
  Synthetic oligonucleotide
tgtcacctggcaaccatttt

SEQ ID NO: 25 - DNA, 20 bp, Artificial sequence
  Synthetic oligonucleotide
gcacaagcataaaaggttcc

SEQ ID NO: 26 - DNA, 20 bp, Artificial sequence
  Synthetic oligonucleotide
tgggagatccggcagccctc

SEQ ID NO: 27 - DNA, 20 bp, Artificial sequence
  Synthetic oligonucleotide
gccattgtcctctgggtagg

SEQ ID NO: 28 - DNA, 20 bp, Artificial sequence
  Synthetic oligonucleotide
tccaggtggctcagcagctt

SEQ ID NO: 29 - DNA, 20 bp, Artificial sequence
  Synthetic oligonucleotide
atccagaggaccacgcccct

SEQ ID NO: 30 - DNA, 20 bp, Artificial sequence
  Synthetic oligonucleotide
gggccatccagaggaccacg

SEQ ID NO: 31 - DNA, 20 bp, Artificial sequence
  Synthetic oligonucleotide
cgtcccagtagatcctgctc

SEQ ID NO: 32 - DNA, 20 bp, Artificial sequence
  Synthetic oligonucleotide
gtcaaagagcttgcaggtct

SEQ ID NO: 33 - DNA, 20 bp, Artificial sequence
  Synthetic oligonucleotide
tgtgtgtcaaagagcttgca

SEQ ID NO: 34 - DNA, 20 bp, Artificial sequence
  Synthetic oligonucleotide
gttgtctggctagcagaggt

SEQ ID NO: 35 - DNA, 20 bp, Artificial sequence
  Synthetic oligonucleotide
ttgttgagcaaaataatata

SEQ ID NO: 36 - DNA, 20 bp, Artificial sequence
  Synthetic oligonucleotide
gtagcccctcaggaaatgtc

SEQ ID NO: 37 - DNA, 20 bp, Artificial sequence
  Synthetic oligonucleotide
tctggattgctgatgtgttc

SEQ ID NO: 38 - DNA, 20 bp, Artificial sequence
  Synthetic oligonucleotide
gtggtaatcttctggattgc

SEQ ID NO: 39 - DNA, 20 bp, Artificial sequence
  Synthetic oligonucleotide
gaggaatggcggatagatct

SEQ ID NO: 40 - DNA, 20 bp, Artificial sequence
  Synthetic oligonucleotide
cactaaagtcaaatatttac

SEQ ID NO: 41 - DNA, 20 bp, Artificial sequence
  Synthetic oligonucleotide
gctttcactaaagtcaaata

SEQ ID NO: 42 - DNA, 20 bp, Artificial sequence
  Synthetic oligonucleotide
cagatgtcactgattttcca

SEQ ID NO: 43 - DNA, 20 bp, Artificial sequence
  Synthetic oligonucleotide
ccaatcagatgtcactgatt

SEQ ID NO: 44 - DNA, 20 bp, Artificial sequence
  Synthetic oligonucleotide
taagctcatctgccaatcag

SEQ ID NO: 45 - DNA, 20 bp, Artificial sequence
  Synthetic oligonucleotide
ccaaggctacaggcacggct

SEQ ID NO: 46 - DNA, 20 bp, Artificial sequence
  Synthetic oligonucleotide
acaccaggaaaccgctggca

SEQ ID NO: 47 - DNA, 20 bp, Artificial sequence
  Synthetic oligonucleotide
cttccaggaaaggccaagga

SEQ ID NO: 48 - DNA, 20 bp, Artificial sequence
  Synthetic oligonucleotide
tgtcccatccaagagtagcg

SEQ ID NO: 49 - DNA, 20 bp, Artificial sequence
  Synthetic oligonucleotide
cttccagtggtgggtcctgg

SEQ ID NO: 50 - DNA, 20 bp, Artificial sequence
  Synthetic oligonucleotide
aacagcccactgagtgtgca

SEQ ID NO: 51 - DNA, 20 bp, Artificial sequence
  Synthetic oligonucleotide
agcagaaacagcccactgag

SEQ ID NO: 52 - DNA, 20 bp, Artificial sequence
  Synthetic oligonucleotide
ctgggtacatggcagtggag

SEQ ID NO: 53 - DNA, 20 bp, Artificial sequence
  Synthetic oligonucleotide
gcattttccagaaaattcag

SEQ ID NO: 54 - DNA, 20 bp, Artificial sequence
  Synthetic oligonucleotide
cccagagttgttccacccct

SEQ ID NO: 55 - DNA, 20 bp, Artificial sequence
  Synthetic oligonucleotide
gctggccacagaggacttcg

SEQ ID NO: 56 - DNA, 20 bp, Artificial sequence
  Synthetic oligonucleotide
gccttcacgcaccattcaga

SEQ ID NO: 57 - DNA, 20 bp, Artificial sequence
  Synthetic oligonucleotide
ccacctgcatcgagatcagt

SEQ ID NO: 58 - DNA, 20 bp, Artificial sequence
  Synthetic oligonucleotide
ggagatccacctgcatcgag

SEQ ID NO: 59 - DNA, 20 bp, Artificial sequence
  Synthetic oligonucleotide
ggaagtggaccccattgcct

SEQ ID NO: 60 - DNA, 20 bp, Artificial sequence
  Synthetic oligonucleotide
atctaaggcaagctgaatgc

SEQ ID NO: 61 - DNA, 20 bp, Artificial sequence
  Synthetic oligonucleotide
acagcatctaaggcaagctg

SEQ ID NO: 62 - DNA, 20 bp, Artificial sequence
  Synthetic oligonucleotide
gaatttacagcatctaaggc

SEQ ID NO: 63 - DNA, 20 bp, Artificial sequence
  Synthetic oligonucleotide
ttcctgaatttacagcatct

SEQ ID NO: 64 - DNA, 20 bp, Artificial sequence
  Synthetic oligonucleotide
gccggagaccttgaagagcg

SEQ ID NO: 65 - DNA, 20 bp, Artificial sequence
  Synthetic oligonucleotide
actggtcagaatcttgaaaa

SEQ ID NO: 66 - DNA, 20 bp, Artificial sequence
  Synthetic oligonucleotide
gttgtgaacctgctaaagga

SEQ ID NO: 67 - DNA, 20 bp, Artificial sequence
  Synthetic oligonucleotide
cctggcaacctgcatttgca

SEQ ID NO: 68 - DNA, 20 bp, Artificial sequence
  Synthetic oligonucleotide
tgtcacctggcaacctgcat

SEQ ID NO: 69 - DNA, 20 bp, Artificial sequence
  Synthetic oligonucleotide
gggcaggtttcatttcattt

SEQ ID NO: 70 - DNA, 20 bp, Artificial sequence
  Synthetic oligonucleotide
gccggcagtctgcaaacaca

SEQ ID NO: 71 - DNA, 20 bp, Artificial sequence
  Synthetic oligonucleotide
cagaggttctacctttaata

SEQ ID NO: 72 - DNA, 16 bp, Artificial sequence
  Synthetic oligonucleotide
gctcatgccgaactct

SEQ ID NO: 73 - DNA, 16 bp, Artificial sequence
  Synthetic oligonucleotide
gctgtcgatctggtcg

SEQ ID NO: 74 - DNA, 16 bp, Artificial sequence
  Synthetic oligonucleotide
gccgctgtcgatctgg

SEQ ID NO: 75 - DNA, 16 bp, Artificial sequence
  Synthetic oligonucleotide
cttgccgctgtcgatc

SEQ ID NO: 76 - DNA, 16 bp, Artificial sequence
  Synthetic oligonucleotide
gtacttgccgctgtcg

SEQ ID NO: 77 - DNA, 16 bp, Artificial sequence
  Synthetic oligonucleotide
cccacaccagcccggg

SEQ ID NO: 78 - DNA, 16 bp, Artificial sequence
  Synthetic oligonucleotide
tctcccacaccagccc

SEQ ID NO: 79 - DNA, 16 bp, Artificial sequence
  Synthetic oligonucleotide
cgttctcccacaccag

SEQ ID NO: 80 - DNA, 16 bp, Artificial sequence
  Synthetic oligonucleotide
gtcctgcttgcccgcg

SEQ ID NO: 81 - DNA, 16 bp, Artificial sequence
  Synthetic oligonucleotide
gtagtcctgcttgccc

SEQ ID NO: 82 - DNA, 16 bp, Artificial sequence
  Synthetic oligonucleotide
cccaagccttgaagag

SEQ ID NO: 83 - DNA, 16 bp, Artificial sequence
  Synthetic oligonucleotide
aagtcattgctcttgt

SEQ ID NO: 84 - DNA, 16 bp, Artificial sequence
  Synthetic oligonucleotide
tcaaagtcattgctct

SEQ ID NO: 85 - DNA, 16 bp, Artificial sequence
  Synthetic oligonucleotide
tcctcaaagtcattgc

SEQ ID NO: 86 - DNA, 16 bp, Artificial sequence
  Synthetic oligonucleotide
gaacaatcctgtacac

SEQ ID NO: 87 - DNA, 16 bp, Artificial sequence
  Synthetic oligonucleotide
cttttttggctccctc

SEQ ID NO: 88 - DNA, 16 bp, Artificial sequence
  Synthetic oligonucleotide
ctccttttttggctcc

SEQ ID NO: 89 - DNA, 16 bp, Artificial sequence
  Synthetic oligonucleotide
gaacctgctgggctgg

SEQ ID NO: 90 - DNA, 16 bp, Artificial sequence
  Synthetic oligonucleotide
cttgccagtggtggcc

SEQ ID NO: 91 - DNA, 16 bp, Artificial sequence
  Synthetic oligonucleotide
ggccttgccagtggtg

SEQ ID NO: 92 - DNA, 16 bp, Artificial sequence
  Synthetic oligonucleotide
caaccattttcacaag

SEQ ID NO: 93 - DNA, 16 bp, Artificial sequence
  Synthetic oligonucleotide
tggcaaccattttcac

SEQ ID NO: 94 - DNA, 16 bp, Artificial sequence
  Synthetic oligonucleotide
acctggcaaccatttt

SEQ ID NO: 95 - DNA, 16 bp, Artificial sequence
  Synthetic oligonucleotide
gtcacctggcaaccat

SEQ ID NO: 96 - DNA, 16 bp, Artificial sequence
  Synthetic oligonucleotide
cctgtcacctggcaac

SEQ ID NO: 97 - DNA, 16 bp, Artificial sequence
  Synthetic oligonucleotide
gttcctgtcacctggc

SEQ ID NO: 98 - DNA, 16 bp, Artificial sequence
  Synthetic oligonucleotide
aaggttcctgtcacct

SEQ ID NO: 99 - DNA, 16 bp, Artificial sequence
  Synthetic oligonucleotide
taaaaggttcctgtca

SEQ ID NO: 100 - DNA, 16 bp, Artificial sequence
  Synthetic oligonucleotide
gcataaaaggttcctg

SEQ ID NO: 101 - DNA, 16 bp, Artificial sequence
  Synthetic oligonucleotide
acaagcataaaaggtt

SEQ ID NO: 102 - DNA, 16 bp, Artificial sequence
  Synthetic oligonucleotide
cctgggactcaggtgg

SEQ ID NO: 103 - DNA, 16 bp, Artificial sequence
  Synthetic oligonucleotide
gagcctgggactcagg

SEQ ID NO: 104 - DNA, 16 bp, Artificial sequence
  Synthetic oligonucleotide
accttatgcttggctc

SEQ ID NO: 105 - DNA, 16 bp, Artificial sequence
  Synthetic oligonucleotide
cagaccttatgcttgg

SEQ ID NO: 106 - DNA, 16 bp, Artificial sequence
  Synthetic oligonucleotide
gggagatccggcagcc

SEQ ID NO: 107 - DNA, 16 bp, Artificial sequence
  Synthetic oligonucleotide
cctggtccaggttgct

SEQ ID NO: 108 - DNA, 16 bp, Artificial sequence
  Synthetic oligonucleotide
ggacctggtccaggtt

SEQ ID NO: 109 - DNA, 16 bp, Artificial sequence
  Synthetic oligonucleotide
acaggacctggtccag

SEQ ID NO: 110 - DNA, 16 bp, Artificial sequence
  Synthetic oligonucleotide
tccaggtggctcagca

SEQ ID NO: 111 - DNA, 16 bp, Artificial sequence
  Synthetic oligonucleotide
ctctccaggtggctca

SEQ ID NO: 112 - DNA, 16 bp, Artificial sequence
  Synthetic oligonucleotide
cccctctccaggtggc

SEQ ID NO: 113 - DNA, 16 bp, Artificial sequence
  Synthetic oligonucleotide
tgtgtcaaagagcttg

SEQ ID NO: 114 - DNA, 16 bp, Artificial sequence
  Synthetic oligonucleotide
gctgtgtgtcaaagag

SEQ ID NO: 115 - DNA, 16 bp, Artificial sequence
  Synthetic oligonucleotide
actgctgtgtgtcaaa

SEQ ID NO: 116 - DNA, 16 bp, Artificial sequence
  Synthetic oligonucleotide
gagtcacctggaatct

SEQ ID NO: 117 - DNA, 16 bp, Artificial sequence
  Synthetic oligonucleotide
ggtctggaaactcctc

SEQ ID NO: 118 - DNA, 16 bp, Artificial sequence
  Synthetic oligonucleotide
gagggtctggaaactc

SEQ ID NO: 119 - DNA, 16 bp, Artificial sequence
  Synthetic oligonucleotide
tctgagggtctggaaa

SEQ ID NO: 120 - DNA, 16 bp, Artificial sequence
  Synthetic oligonucleotide
gagctgtgatgagctt

SEQ ID NO: 121 - DNA, 16 bp, Artificial sequence
  Synthetic oligonucleotide
tggctagcagaggttc

SEQ ID NO: 122 - DNA, 16 bp, Artificial sequence
  Synthetic oligonucleotide
gtctggctagcagagg

SEQ ID NO: 123 - DNA, 16 bp, Artificial sequence
  Synthetic oligonucleotide
gttgtctggctagcag

SEQ ID NO: 124 - DNA, 16 bp, Artificial sequence
  Synthetic oligonucleotide
cctcaggaaatgtcca

SEQ ID NO: 125 - DNA, 16 bp, Artificial sequence
  Synthetic oligonucleotide
agcccctcaggaaatg

SEQ ID NO: 126 - DNA, 16 bp, Artificial sequence
  Synthetic oligonucleotide
cttccctgagaaatgg

SEQ ID NO: 127 - DNA, 16 bp, Artificial sequence
  Synthetic oligonucleotide
ttacttccctgagaaa

SEQ ID NO: 128 - DNA, 16 bp, Artificial sequence
  Synthetic oligonucleotide
aataagcagaaacagc

SEQ ID NO: 129 - DNA, 16 bp, Artificial sequence
  Synthetic oligonucleotide
atctataagatgtata

SEQ ID NO: 130 - DNA, 16 bp, Artificial sequence
  Synthetic oligonucleotide
tgcatctataagatgt

SEQ ID NO: 131 - DNA, 16 bp, Artificial sequence
  Synthetic oligonucleotide
tccagaaaattcagct

SEQ ID NO: 132 - DNA, 16 bp, Artificial sequence
  Synthetic oligonucleotide
gcattttccagaaaat

SEQ ID NO: 133 - DNA, 16 bp, Artificial sequence
  Synthetic oligonucleotide
accttttttggctccc

SEQ ID NO: 134 - DNA, 16 bp, Artificial sequence
  Synthetic oligonucleotide
attcttagaatgcata

SEQ ID NO: 135 - DNA, 16 bp, Artificial sequence
  Synthetic oligonucleotide
caaactcctcagggaa

SEQ ID NO: 136 - DNA, 16 bp, Artificial sequence
  Synthetic oligonucleotide
ttaccattttcacaag

SEQ ID NO: 137 - DNA, 16 bp, Artificial sequence
  Synthetic oligonucleotide
aatcagatgatgtcta

SEQ ID NO: 138 - DNA, 16 bp, Artificial sequence
  Synthetic oligonucleotide
ctgcatttgcaaataa

SEQ ID NO: 139 - DNA, 16 bp, Artificial sequence
  Synthetic oligonucleotide
ggcaacctgcatttgc

SEQ ID NO: 140 - DNA, 16 bp, Artificial sequence
  Synthetic oligonucleotide
tcacctggcaacctgc

SEQ ID NO: 141 - DNA, 16 bp, Artificial sequence
  Synthetic oligonucleotide
cacccacacaagtctt

SEQ ID NO: 142 - DNA, 16 bp, Artificial sequence
  Synthetic oligonucleotide
gtttatttcctactct

SEQ ID NO: 143 - DNA, 16 bp, Artificial sequence
  Synthetic oligonucleotide
atagctgtttatttcc

SEQ ID NO: 144 - DNA, 16 bp, Artificial sequence
  Synthetic oligonucleotide
gatataaatagctgtt

SEQ ID NO: 145 - DNA, 16 bp, Artificial sequence
  Synthetic oligonucleotide
catttcatttaatgtc

SEQ ID NO: 146 - DNA, 16 bp, Artificial sequence
  Synthetic oligonucleotide
caggtttcatttcatt

SEQ ID NO: 147 - DNA, 16 bp, Artificial sequence
  Synthetic oligonucleotide
cctccattctaacaga

SEQ ID NO: 148 - DNA, 16 bp, Artificial sequence
  Synthetic oligonucleotide
tggccacagaggactt

SEQ ID NO: 149 - DNA, 16 bp, Artificial sequence
  Synthetic oligonucleotide
actgagagtgcgaggt

SEQ ID NO: 150 - DNA, 16 bp, Artificial sequence
  Synthetic oligonucleotide
ccaggttcatgccccg

SEQ ID NO: 151 - DNA, 16 bp, Artificial sequence
  Synthetic oligonucleotide
gcttcccgttgccgca

SEQ ID NO: 152 - DNA, 16 bp, Artificial sequence
  Synthetic oligonucleotide
gttgtagtcctgcttg

SEQ ID NO: 153 - DNA, 16 bp, Artificial sequence
  Synthetic oligonucleotide
cttgttcaaagcgcac

SEQ ID NO: 154 - DNA, 16 bp, Artificial sequence
  Synthetic oligonucleotide
tttgtacgggtctgag

SEQ ID NO: 155 - DNA, 16 bp, Artificial sequence
  Synthetic oligonucleotide
gtgtggctgatccggg

SEQ ID NO: 156 - DNA, 16 bp, Artificial sequence
  Synthetic oligonucleotide
ctgggccttgccagtg

SEQ ID NO: 157 - DNA, 16 bp, Artificial sequence
  Synthetic oligonucleotide
gactccgggagcctgg

SEQ ID NO: 158 - DNA, 16 bp, Artificial sequence
  Synthetic oligonucleotide
ttgtcctctgggtagg

SEQ ID NO: 159 - DNA, 16 bp, Artificial sequence
  Synthetic oligonucleotide
ccgtcccagtagatcc

SEQ ID NO: 160 - DNA, 16 bp, Artificial sequence
  Synthetic oligonucleotide
agcttgcaggtctggt

SEQ ID NO: 161 - DNA, 16 bp, Artificial sequence
  Synthetic oligonucleotide
gtaatcttctggattg

SEQ ID NO: 162 - DNA, 16 bp, Artificial sequence
  Synthetic oligonucleotide
tccccgtatcaaaaaa

SEQ ID NO: 163 - DNA, 16 bp, Artificial sequence
  Synthetic oligonucleotide
cacttgtcttgggtgg

SEQ ID NO: 164 - DNA, 16 bp, Artificial sequence
  Synthetic oligonucleotide
aacagtaagagggcag

SEQ ID NO: 165 - DNA, 16 bp, Artificial sequence
  Synthetic oligonucleotide
gcaaagccacccttcc

SEQ ID NO: 166 - DNA, 16 bp, Artificial sequence
  Synthetic oligonucleotide
tcttccagcaagacct

SEQ ID NO: 167 - DNA, 16 bp, Artificial sequence
  Synthetic oligonucleotide
atacatttcttttacg

SEQ ID NO: 168 - DNA, 16 bp, Artificial sequence
  Synthetic oligonucleotide
gattcatttccttcac

SEQ ID NO: 169 - DNA, 16 bp, Artificial sequence
  Synthetic oligonucleotide
gaaaccgctggcaggt

SEQ ID NO: 170 - DNA, 16 bp, Artificial sequence
  Synthetic oligonucleotide
tccaggaaaggccaag

SEQ ID NO: 171 - DNA, 16 bp, Artificial sequence
  Synthetic oligonucleotide
taactggcttccagga

SEQ ID NO: 172 - DNA, 16 bp, Artificial sequence
  Synthetic oligonucleotide
aaaaatgtcccatcca

SEQ ID NO: 173 - DNA, 16 bp, Artificial sequence
  Synthetic oligonucleotide
gtcaaaaagatgcaga

SEQ ID NO: 174 - DNA, 16 bp, Artificial sequence
  Synthetic oligonucleotide
gatttatgttccttaa

SEQ ID NO: 175 - DNA, 16 bp, Artificial sequence
  Synthetic oligonucleotide
aacaaacagaggagcg

SEQ ID NO: 176 - DNA, 16 bp, Artificial sequence
  Synthetic oligonucleotide
gcctgggagtccccgg

SEQ ID NO: 177 - DNA, 16 bp, Artificial sequence
  Synthetic oligonucleotide
gtgcagttccgtagtc

SEQ ID NO: 178 - DNA, 16 bp, Artificial sequence
  Synthetic oligonucleotide
actataattggcacga

SEQ ID NO: 179 - DNA, 16 bp, Artificial sequence
  Synthetic oligonucleotide
tctttgggattctata

SEQ ID NO: 180 - DNA, 16 bp, Artificial sequence
  Synthetic oligonucleotide
ggagtaatagtaaata

SEQ ID NO: 181 - DNA, 16 bp, Artificial sequence
  Synthetic oligonucleotide
ctgctcactaagcttg

SEQ ID NO: 182 - DNA, 16 bp, Artificial sequence
  Synthetic oligonucleotide
gtattaatattctgac

SEQ ID NO: 183 - DNA, 16 bp, Artificial sequence
  Synthetic oligonucleotide
ggagatcctttttatt

SEQ ID NO: 184 - DNA, 16 bp, Artificial sequence
  Synthetic oligonucleotide
gactccatgaggtttt

SEQ ID NO: 185 - DNA, 16 bp, Artificial sequence
  Synthetic oligonucleotide
gggtacatggcagtgg

SEQ ID NO: 186 - DNA, 16 bp, Artificial sequence
  Synthetic oligonucleotide
gcagttcttaatatca

SEQ ID NO: 187 - DNA, 16 bp, Artificial sequence
  Synthetic oligonucleotide
tgaagtgctgtgtggg

SEQ ID NO: 188 - DNA, 16 bp, Artificial sequence
  Synthetic oligonucleotide
tccgcttggagaatta

SEQ ID NO: 189 - DNA, 16 bp, Artificial sequence
  Synthetic oligonucleotide
gttaaagcagcataat

SEQ ID NO: 190 - DNA, 16 bp, Artificial sequence
  Synthetic oligonucleotide
agatgtaaagatagga

SEQ ID NO: 191 - DNA, 16 bp, Artificial sequence
  Synthetic oligonucleotide
agttcattccctaggt

SEQ ID NO: 192 - DNA, 16 bp, Artificial sequence
  Synthetic oligonucleotide
gttccttttcagagtc

SEQ ID NO: 193 - DNA, 16 bp, Artificial sequence
  Synthetic oligonucleotide
agtacaaactaaattc

SEQ ID NO: 194 - DNA, 16 bp, Artificial sequence
  Synthetic oligonucleotide
gaggttttcctaaata

SEQ ID NO: 195 - DNA, 16 bp, Artificial sequence
  Synthetic oligonucleotide
ttgtaaatgagtcggt

SEQ ID NO: 196 - DNA, 16 bp, Artificial sequence
  Synthetic oligonucleotide
ctgtaggattttacat

SEQ ID NO: 197 - DNA, 16 bp, Artificial sequence
  Synthetic oligonucleotide
cagagttgttccaccc

SEQ ID NO: 198 - DNA, 16 bp, Artificial sequence
  Synthetic oligonucleotide
aatgaacggaagttta

SEQ ID NO: 199 - DNA, 16 bp, Artificial sequence
  Synthetic oligonucleotide
aaccaatcccaacact

SEQ ID NO: 200 - DNA, 16 bp, Artificial sequence
  Synthetic oligonucleotide
ttcagacagatgcagc

SEQ ID NO: 201 - DNA, 16 bp, Artificial sequence
  Synthetic oligonucleotide
cagtctcaaaaacggg

SEQ ID NO: 202 - DNA, 16 bp, Artificial sequence
  Synthetic oligonucleotide
acctttacttcattcc

SEQ ID NO: 203 - DNA, 16 bp, Artificial sequence
  Synthetic oligonucleotide
acgggaatttccattg

SEQ ID NO: 204 - DNA, 16 bp, Artificial sequence
  Synthetic oligonucleotide
aagtggaccccattgc

SEQ ID NO: 205 - DNA, 16 bp, Artificial sequence
  Synthetic oligonucleotide
ttcagcagaaagtggg

SEQ ID NO: 206 - DNA, 16 bp, Artificial sequence
  Synthetic oligonucleotide
cgcagagccagtaggg

SEQ ID NO: 207 - DNA, 16 bp, Artificial sequence
  Synthetic oligonucleotide
aaaagcccaaaatagg

SEQ ID NO: 208 - DNA, 16 bp, Artificial sequence
  Synthetic oligonucleotide
ctggcattgagacggg

SEQ ID NO: 209 - DNA, 16 bp, Artificial sequence
  Synthetic oligonucleotide
agcactggcattgaga

SEQ ID NO: 210 - DNA, 16 bp, Artificial sequence
  Synthetic oligonucleotide
taagaagcactggcat

SEQ ID NO: 211 - DNA, 16 bp, Artificial sequence
  Synthetic oligonucleotide
tgagataagaagcact

SEQ ID NO: 212 - DNA, 16 bp, Artificial sequence
  Synthetic oligonucleotide
ggagaggctgagataa

SEQ ID NO: 213 - DNA, 16 bp, Artificial sequence
  Synthetic oligonucleotide
aggagaggctgagata

SEQ ID NO: 214 - DNA, 16 bp, Artificial sequence
  Synthetic oligonucleotide
gtgcaggagaggctga

SEQ ID NO: 215 - DNA, 16 bp, Artificial sequence
  Synthetic oligonucleotide
gagtgcaggagaggct

SEQ ID NO: 216 - DNA, 16 bp, Artificial sequence
  Synthetic oligonucleotide
ggagtgcaggagaggc

SEQ ID NO: 217 - DNA, 16 bp, Artificial sequence
  Synthetic oligonucleotide
taaaggagtgcaggag

SEQ ID NO: 218 - DNA, 16 bp, Artificial sequence
  Synthetic oligonucleotide
gtaaaggagtgcagga

SEQ ID NO: 219 - DNA, 16 bp, Artificial sequence
  Synthetic oligonucleotide
gggtaaaggagtgcag

SEQ ID NO: 220 - DNA, 16 bp, Artificial sequence
  Synthetic oligonucleotide
ctggcatcgagacggg

SEQ ID NO: 221 - DNA, 16 bp, Artificial sequence
  Synthetic oligonucleotide
gcactggcatcgagac

SEQ ID NO: 222 - DNA, 16 bp, Artificial sequence
  Synthetic oligonucleotide
gaagcactggcatcga

SEQ ID NO: 223 - DNA, 16 bp, Artificial sequence
  Synthetic oligonucleotide
cctgaatttacagcat

SEQ ID NO: 224 - DNA, 16 bp, Artificial sequence
  Synthetic oligonucleotide
tgaaactgagagtgcg

SEQ ID NO: 225 - DNA, 16 bp, Artificial sequence
  Synthetic oligonucleotide
cgagcggtgaaactga

SEQ ID NO: 226 - DNA, 16 bp, Artificial sequence
  Synthetic oligonucleotide
ccaagatcgagcggtg

SEQ ID NO: 227 - DNA, 16 bp, Artificial sequence
  Synthetic oligonucleotide
gtgggtcccaagatcg

SEQ ID NO: 228 - DNA, 16 bp, Artificial sequence
  Synthetic oligonucleotide
agctgagggcagcggt

SEQ ID NO: 229 - DNA, 16 bp, Artificial sequence
  Synthetic oligonucleotide
gactcggagctgaggg

SEQ ID NO: 230 - DNA, 16 bp, Artificial sequence
  Synthetic oligonucleotide
cgccctggactcggag

SEQ ID NO: 231 - DNA, 16 bp, Artificial sequence
  Synthetic oligonucleotide
ctgcactcgccctgga

SEQ ID NO: 232 - DNA, 16 bp, Artificial sequence
  Synthetic oligonucleotide
ctctgctctgcactcg

SEQ ID NO: 233 - DNA, 16 bp, Artificial sequence
  Synthetic oligonucleotide
ccgcccgctctgctct

SEQ ID NO: 234 - DNA, 16 bp, Artificial sequence
  Synthetic oligonucleotide
gggtcctccgcccgct

SEQ ID NO: 235 - DNA, 16 bp, Artificial sequence
  Synthetic oligonucleotide
ccgtccgcgcccgcgc

SEQ ID NO: 236 - DNA, 16 bp, Artificial sequence
  Synthetic oligonucleotide
gccgccctccaggttc

SEQ ID NO: 237 - DNA, 16 bp, Artificial sequence
  Synthetic oligonucleotide
ctcggccgccgccctc

SEQ ID NO: 238 - DNA, 16 bp, Artificial sequence
  Synthetic oligonucleotide
tctccgcctcggccgc

SEQ ID NO: 239 - DNA, 16 bp, Artificial sequence
  Synthetic oligonucleotide
gccgaactctccgcct

SEQ ID NO: 240 - DNA, 16 bp, Artificial sequence
  Synthetic oligonucleotide
ccgcgctcatgccgaa

SEQ ID NO: 241 - DNA, 16 bp, Artificial sequence
  Synthetic oligonucleotide
cagctcaccgcgctca

SEQ ID NO: 242 - DNA, 16 bp, Artificial sequence
  Synthetic oligonucleotide
cggagcttcccgttgc

SEQ ID NO: 243 - DNA, 16 bp, Artificial sequence
  Synthetic oligonucleotide
ccactggcggagcttc

SEQ ID NO: 244 - DNA, 16 bp, Artificial sequence
  Synthetic oligonucleotide
cgcggttgtagtcctg

SEQ ID NO: 245 - DNA, 16 bp, Artificial sequence
  Synthetic oligonucleotide
tcctcctcgcggttgt

SEQ ID NO: 246 - DNA, 16 bp, Artificial sequence
  Synthetic oligonucleotide
cttgaagagcgcggcg

SEQ ID NO: 247 - DNA, 16 bp, Artificial sequence
  Synthetic oligonucleotide
agtgcccaagccttga

SEQ ID NO: 248 - DNA, 16 bp, Artificial sequence
  Synthetic oligonucleotide
tcctttaaacagtgcc

SEQ ID NO: 249 - DNA, 16 bp, Artificial sequence
  Synthetic oligonucleotide
cggaactttcctttaa

SEQ ID NO: 250 - DNA, 16 bp, Artificial sequence
  Synthetic oligonucleotide
gccttctcggaacttt

SEQ ID NO: 251 - DNA, 16 bp, Artificial sequence
  Synthetic oligonucleotide
tgtcgatgccttctcg

SEQ ID NO: 252 - DNA, 16 bp, Artificial sequence
  Synthetic oligonucleotide
tccggcttgtcgatgc

SEQ ID NO: 253 - DNA, 16 bp, Artificial sequence
  Synthetic oligonucleotide
cgtcttccaggtggga

SEQ ID NO: 254 - DNA, 16 bp, Artificial sequence
  Synthetic oligonucleotide
ttgctcttgttcaaag

SEQ ID NO: 255 - DNA, 16 bp, Artificial sequence
  Synthetic oligonucleotide
cgctcaaccagttcct

SEQ ID NO: 256 - DNA, 16 bp, Artificial sequence
  Synthetic oligonucleotide
ctggctccgctcaacc

SEQ ID NO: 257 - DNA, 16 bp, Artificial sequence
  Synthetic oligonucleotide
tgtccagctggctccg

SEQ ID NO: 258 - DNA, 16 bp, Artificial sequence
  Synthetic oligonucleotide
tctgagatgtccagct

SEQ ID NO: 259 - DNA, 16 bp, Artificial sequence
  Synthetic oligonucleotide
acactttgtacgggtc

SEQ ID NO: 260 - DNA, 16 bp, Artificial sequence
  Synthetic oligonucleotide
ggctccctcaggaaca

SEQ ID NO: 261 - DNA, 16 bp, Artificial sequence
  Synthetic oligonucleotide
ttggctccttttttgg

SEQ ID NO: 262 - DNA, 16 bp, Artificial sequence
  Synthetic oligonucleotide
gagctgcttggctcct

SEQ ID NO: 263 - DNA, 16 bp, Artificial sequence
  Synthetic oligonucleotide
ccagggtgagctgctt

SEQ ID NO: 264 - DNA, 16 bp, Artificial sequence
  Synthetic oligonucleotide
ctgcgggtcctccagg

SEQ ID NO: 265 - DNA, 16 bp, Artificial sequence
  Synthetic oligonucleotide
tggacatctgcgggtc

SEQ ID NO: 266 - DNA, 16 bp, Artificial sequence
  Synthetic oligonucleotide
tggctcatggacatct

SEQ ID NO: 267 - DNA, 16 bp, Artificial sequence
  Synthetic oligonucleotide
ttgtcatggtgtaggg

SEQ ID NO: 268 - DNA, 16 bp, Artificial sequence
  Synthetic oligonucleotide
agcgaagggtaaggcg

SEQ ID NO: 269 - DNA, 16 bp, Artificial sequence
  Synthetic oligonucleotide
catgtagttgtgaacc

SEQ ID NO: 270 - DNA, 16 bp, Artificial sequence
  Synthetic oligonucleotide
gtggcatcatgtagtt

SEQ ID NO: 271 - DNA, 16 bp, Artificial sequence
  Synthetic oligonucleotide
cagcttcggtcgaggg

SEQ ID NO: 272 - DNA, 16 bp, Artificial sequence
  Synthetic oligonucleotide
gtccctccagcttcgg

SEQ ID NO: 273 - DNA, 16 bp, Artificial sequence
  Synthetic oligonucleotide
ccgggtgtggctgatc

SEQ ID NO: 274 - DNA, 16 bp, Artificial sequence
  Synthetic oligonucleotide
ggacattggtacggga

SEQ ID NO: 275 - DNA, 16 bp, Artificial sequence
  Synthetic oligonucleotide
cgtcatgggacattgg

SEQ ID NO: 276 - DNA, 16 bp, Artificial sequence
  Synthetic oligonucleotide
cagtggtggccgcggg

SEQ ID NO: 277 - DNA, 16 bp, Artificial sequence
  Synthetic oligonucleotide
caagctgggccttgcc

SEQ ID NO: 278 - DNA, 16 bp, Artificial sequence
  Synthetic oligonucleotide
attttcacaagctggg

SEQ ID NO: 279 - DNA, 16 bp, Artificial sequence
  Synthetic oligonucleotide
aaaggttcctgtcacc

SEQ ID NO: 280 - DNA, 16 bp, Artificial sequence
  Synthetic oligonucleotide
cataaaaggttcctgt

SEQ ID NO: 281 - DNA, 16 bp, Artificial sequence
  Synthetic oligonucleotide
agcataaaaggttcct

SEQ ID NO: 282 - DNA, 16 bp, Artificial sequence
  Synthetic oligonucleotide
caagcataaaaggttc

SEQ ID NO: 283 - DNA, 16 bp, Artificial sequence
  Synthetic oligonucleotide
cacaagcataaaaggt

SEQ ID NO: 284 - DNA, 16 bp, Artificial sequence
  Synthetic oligonucleotide
gggcacaagcataaaa

SEQ ID NO: 285 - DNA, 16 bp, Artificial sequence
  Synthetic oligonucleotide
atgcttggctctgtgg

SEQ ID NO: 286 - DNA, 16 bp, Artificial sequence
  Synthetic oligonucleotide
ccatgggagatccggc

SEQ ID NO: 287 - DNA, 16 bp, Artificial sequence
  Synthetic oligonucleotide
cgtatgtccatgggag

SEQ ID NO: 288 - DNA, 16 bp, Artificial sequence
  Synthetic oligonucleotide
gtccaggttgctggcg

SEQ ID NO: 289 - DNA, 16 bp, Artificial sequence
  Synthetic oligonucleotide
gggaacaggacctggt

SEQ ID NO: 290 - DNA, 16 bp, Artificial sequence
  Synthetic oligonucleotide
gccattgtcctctggg

SEQ ID NO: 291 - DNA, 16 bp, Artificial sequence
  Synthetic oligonucleotide
tcctctggccattgtc

SEQ ID NO: 292 - DNA, 16 bp, Artificial sequence
  Synthetic oligonucleotide
gcagcttctcaatgtt

SEQ ID NO: 293 - DNA, 16 bp, Artificial sequence
  Synthetic oligonucleotide
ggtggctcagcagctt

SEQ ID NO: 294 - DNA, 16 bp, Artificial sequence
  Synthetic oligonucleotide
accacgcccctctcca

SEQ ID NO: 295 - DNA, 16 bp, Artificial sequence
  Synthetic oligonucleotide
ccagaggaccacgccc

SEQ ID NO: 296 - DNA, 16 bp, Artificial sequence
  Synthetic oligonucleotide
gcacagtcttttcgca

SEQ ID NO: 297 - DNA, 16 bp, Artificial sequence
  Synthetic oligonucleotide
ctgctctggcacagtc

SEQ ID NO: 298 - DNA, 16 bp, Artificial sequence
  Synthetic oligonucleotide
gtagatcctgctctgg

SEQ ID NO: 299 - DNA, 16 bp, Artificial sequence
  Synthetic oligonucleotide
gggcccgtcccagtag

SEQ ID NO: 300 - DNA, 16 bp, Artificial sequence
  Synthetic oligonucleotide
tctctccagtttgttg

SEQ ID NO: 301 - DNA, 16 bp, Artificial sequence
  Synthetic oligonucleotide
aaagagcttgcaggtc

SEQ ID NO: 302 - DNA, 16 bp, Artificial sequence
  Synthetic oligonucleotide
aagaactgctgtgtgt

SEQ ID NO: 303 - DNA, 16 bp, Artificial sequence
  Synthetic oligonucleotide
ctctgacaagaactgc

SEQ ID NO: 304 - DNA, 16 bp, Artificial sequence
  Synthetic oligonucleotide
cttgcagctctgacaa

SEQ ID NO: 305 - DNA, 16 bp, Artificial sequence
  Synthetic oligonucleotide
gagcggccgtggtgag

SEQ ID NO: 306 - DNA, 16 bp, Artificial sequence
  Synthetic oligonucleotide
tggcagggagcggccg

SEQ ID NO: 307 - DNA, 16 bp, Artificial sequence
  Synthetic oligonucleotide
ggaatcttggcaggga

SEQ ID NO: 308 - DNA, 16 bp, Artificial sequence
  Synthetic oligonucleotide
tccaaagcatagagtc

SEQ ID NO: 309 - DNA, 16 bp, Artificial sequence
  Synthetic oligonucleotide
tggaaactcctctcca

SEQ ID NO: 310 - DNA, 16 bp, Artificial sequence
  Synthetic oligonucleotide
gagctttctttgcctc

SEQ ID NO: 311 - DNA, 16 bp, Artificial sequence
  Synthetic oligonucleotide
tagcagaggttctacg

SEQ ID NO: 312 - DNA, 16 bp, Artificial sequence
  Synthetic oligonucleotide
ttgtctggctagcaga

SEQ ID NO: 313 - DNA, 16 bp, Artificial sequence
  Synthetic oligonucleotide
agttgtctggctagca

SEQ ID NO: 314 - DNA, 16 bp, Artificial sequence
  Synthetic oligonucleotide
atagttgtctggctag

SEQ ID NO: 315 - DNA, 16 bp, Artificial sequence
  Synthetic oligonucleotide
atatagttgtctggct

SEQ ID NO: 316 - DNA, 16 bp, Artificial sequence
  Synthetic oligonucleotide
aatgtccactgttttg

SEQ ID NO: 317 - DNA, 16 bp, Artificial sequence
  Synthetic oligonucleotide
tgctgatgtgttctgg

SEQ ID NO: 318 - DNA, 16 bp, Artificial sequence
  Synthetic oligonucleotide
atagatctgtggtaat

SEQ ID NO: 319 - DNA, 16 bp, Artificial sequence
  Synthetic oligonucleotide
atggcggatagatctg

SEQ ID NO: 320 - DNA, 16 bp, Artificial sequence
  Synthetic oligonucleotide
tagaggaatggcggat

SEQ ID NO: 321 - DNA, 16 bp, Artificial sequence
  Synthetic oligonucleotide
tcttgaatagaggaat

SEQ ID NO: 322 - DNA, 16 bp, Artificial sequence
  Synthetic oligonucleotide
cactcatcttgacatt

SEQ ID NO: 323 - DNA, 16 bp, Artificial sequence
  Synthetic oligonucleotide
aagaccccgtatcccc

SEQ ID NO: 324 - DNA, 16 bp, Artificial sequence
  Synthetic oligonucleotide
aaatcacttgtcttgg

SEQ ID NO: 325 - DNA, 16 bp, Artificial sequence
  Synthetic oligonucleotide
ctttcactaaagtcaa

SEQ ID NO: 326 - DNA, 16 bp, Artificial sequence
  Synthetic oligonucleotide
gcagtcaattggacgc

SEQ ID NO: 327 - DNA, 16 bp, Artificial sequence
  Synthetic oligonucleotide
taagagggcagtcaat

SEQ ID NO: 328 - DNA, 16 bp, Artificial sequence
  Synthetic oligonucleotide
tccacttctgaattcc

SEQ ID NO: 329 - DNA, 16 bp, Artificial sequence
  Synthetic oligonucleotide
ctgaactgaaatctcc

SEQ ID NO: 330 - DNA, 16 bp, Artificial sequence
  Synthetic oligonucleotide
tcaaccgctgaactga

SEQ ID NO: 331 - DNA, 16 bp, Artificial sequence
  Synthetic oligonucleotide
attctcctcaaccgct

SEQ ID NO: 332 - DNA, 16 bp, Artificial sequence
  Synthetic oligonucleotide
cttgtctcgccgcaat

SEQ ID NO: 333 - DNA, 16 bp, Artificial sequence
  Synthetic oligonucleotide
ttccatgcttgtctcg

SEQ ID NO: 334 - DNA, 16 bp, Artificial sequence
  Synthetic oligonucleotide
tcagatgtcactgatt

SEQ ID NO: 335 - DNA, 16 bp, Artificial sequence
  Synthetic oligonucleotide
agctcatctgccaatc

SEQ ID NO: 336 - DNA, 16 bp, Artificial sequence
  Synthetic oligonucleotide
ttgaaataagctcatc

SEQ ID NO: 337 - DNA, 16 bp, Artificial sequence
  Synthetic oligonucleotide
tctacagaacacaaga

SEQ ID NO: 338 - DNA, 16 bp, Artificial sequence
  Synthetic oligonucleotide
atggcagtctacagaa

SEQ ID NO: 339 - DNA, 16 bp, Artificial sequence
  Synthetic oligonucleotide
atcaatgatggcagtc

SEQ ID NO: 340 - DNA, 16 bp, Artificial sequence
  Synthetic oligonucleotide
acagtgatcatcaatg

SEQ ID NO: 341 - DNA, 16 bp, Artificial sequence
  Synthetic oligonucleotide
aattttcacagtgatc

SEQ ID NO: 342 - DNA, 16 bp, Artificial sequence
  Synthetic oligonucleotide
cttggtcaattttcac

SEQ ID NO: 343 - DNA, 16 bp, Artificial sequence
  Synthetic oligonucleotide
cacatcacttggtcaa

SEQ ID NO: 344 - DNA, 16 bp, Artificial sequence
  Synthetic oligonucleotide
taaagagcgcatttca

SEQ ID NO: 345 - DNA, 16 bp, Artificial sequence
  Synthetic oligonucleotide
aacaaattaaagagcg

SEQ ID NO: 346 - DNA, 16 bp, Artificial sequence
  Synthetic oligonucleotide
ctaatctacaacaaat

SEQ ID NO: 347 - DNA, 16 bp, Artificial sequence
  Synthetic oligonucleotide
gcaagttttctctgtc

SEQ ID NO: 348 - DNA, 16 bp, Artificial sequence
  Synthetic oligonucleotide
ctagtcagtgtcaata

SEQ ID NO: 349 - DNA, 16 bp, Artificial sequence
  Synthetic oligonucleotide
catcactctagtcagt

SEQ ID NO: 350 - DNA, 16 bp, Artificial sequence
  Synthetic oligonucleotide
aagcagtcatcactct

SEQ ID NO: 351 - DNA, 16 bp, Artificial sequence
  Synthetic oligonucleotide
gcacagacatacctac

SEQ ID NO: 352 - DNA, 16 bp, Artificial sequence
  Synthetic oligonucleotide
caatttacatcttact

SEQ ID NO: 353 - DNA, 16 bp, Artificial sequence
  Synthetic oligonucleotide
gcttcttcaatttaca

SEQ ID NO: 354 - DNA, 16 bp, Artificial sequence
  Synthetic oligonucleotide
gcagctcctacataca

SEQ ID NO: 355 - DNA, 16 bp, Artificial sequence
  Synthetic oligonucleotide
caagaactgcagctcc

SEQ ID NO: 356 - DNA, 16 bp, Artificial sequence
  Synthetic oligonucleotide
gtcttccacaagaact

SEQ ID NO: 357 - DNA, 16 bp, Artificial sequence
  Synthetic oligonucleotide
agcaagtgtcttccac

SEQ ID NO: 358 - DNA, 16 bp, Artificial sequence
  Synthetic oligonucleotide
cttcactcagcaagtg

SEQ ID NO: 359 - DNA, 16 bp, Artificial sequence
  Synthetic oligonucleotide
cagtcaaagattcatt

SEQ ID NO: 360 - DNA, 16 bp, Artificial sequence
  Synthetic oligonucleotide
tacaggcacggcttca

SEQ ID NO: 361 - DNA, 16 bp, Artificial sequence
  Synthetic oligonucleotide
ccaaggctacaggcac

SEQ ID NO: 362 - DNA, 16 bp, Artificial sequence
  Synthetic oligonucleotide
ggcctccccaaggcta

SEQ ID NO: 363 - DNA, 16 bp, Artificial sequence
  Synthetic oligonucleotide
ccaggaaaccgctggc

SEQ ID NO: 364 - DNA, 16 bp, Artificial sequence
  Synthetic oligonucleotide
gacccacaccaggaaa

SEQ ID NO: 365 - DNA, 16 bp, Artificial sequence
  Synthetic oligonucleotide
gcagagggacccacac

SEQ ID NO: 366 - DNA, 16 bp, Artificial sequence
  Synthetic oligonucleotide
ttactaactggcttcc

SEQ ID NO: 367 - DNA, 16 bp, Artificial sequence
  Synthetic oligonucleotide
aggaagtttactaact

SEQ ID NO: 368 - DNA, 16 bp, Artificial sequence
  Synthetic oligonucleotide
gactcaagaaaatagg

SEQ ID NO: 369 - DNA, 16 bp, Artificial sequence
  Synthetic oligonucleotide
gttttttgactcaaga

SEQ ID NO: 370 - DNA, 16 bp, Artificial sequence
  Synthetic oligonucleotide
catccaagagtagcgc

SEQ ID NO: 371 - DNA, 16 bp, Artificial sequence
  Synthetic oligonucleotide
gtaggacagacaaaaa

SEQ ID NO: 372 - DNA, 16 bp, Artificial sequence
  Synthetic oligonucleotide
ctagattgtaggacag

SEQ ID NO: 373 - DNA, 16 bp, Artificial sequence
  Synthetic oligonucleotide
gacattactagattgt

SEQ ID NO: 374 - DNA, 16 bp, Artificial sequence
  Synthetic oligonucleotide
ttacttagacattact

SEQ ID NO: 375 - DNA, 16 bp, Artificial sequence
  Synthetic oligonucleotide
ttaaccattacttaga

SEQ ID NO: 376 - DNA, 16 bp, Artificial sequence
  Synthetic oligonucleotide
gagggtcaaaaagatg

SEQ ID NO: 377 - DNA, 16 bp, Artificial sequence
  Synthetic oligonucleotide
gcatctctaaagaatg

SEQ ID NO: 378 - DNA, 16 bp, Artificial sequence
  Synthetic oligonucleotide
gaagaattttagcatc

SEQ ID NO: 379 - DNA, 16 bp, Artificial sequence
  Synthetic oligonucleotide
tttatgcgaagaattt

SEQ ID NO: 380 - DNA, 16 bp, Artificial sequence
  Synthetic oligonucleotide
cttcttctttatgcga

SEQ ID NO: 381 - DNA, 16 bp, Artificial sequence
  Synthetic oligonucleotide
ttaagatttatgttcc

SEQ ID NO: 382 - DNA, 16 bp, Artificial sequence
  Synthetic oligonucleotide
ggcaacagttcaagta

SEQ ID NO: 383 - DNA, 16 bp, Artificial sequence
  Synthetic oligonucleotide
acagaagggcaacagt

SEQ ID NO: 384 - DNA, 16 bp, Artificial sequence
  Synthetic oligonucleotide
tacttggacagaaggg

SEQ ID NO: 385 - DNA, 16 bp, Artificial sequence
  Synthetic oligonucleotide
agttaagtacttggac

SEQ ID NO: 386 - DNA, 16 bp, Artificial sequence
  Synthetic oligonucleotide
aacagatagttaagta

SEQ ID NO: 387 - DNA, 16 bp, Artificial sequence
  Synthetic oligonucleotide
gccaaacaaacagagg

SEQ ID NO: 388 - DNA, 16 bp, Artificial sequence
  Synthetic oligonucleotide
ctggacagccaaacaa

SEQ ID NO: 389 - DNA, 16 bp, Artificial sequence
  Synthetic oligonucleotide
ctgatcgctggacagc

SEQ ID NO: 390 - DNA, 16 bp, Artificial sequence
  Synthetic oligonucleotide
gccatggctgatcgct

SEQ ID NO: 391 - DNA, 16 bp, Artificial sequence
  Synthetic oligonucleotide
tagtgtcgccatggct

SEQ ID NO: 392 - DNA, 16 bp, Artificial sequence
  Synthetic oligonucleotide
cctcctttagtgtcgc

SEQ ID NO: 393 - DNA, 16 bp, Artificial sequence
  Synthetic oligonucleotide
cggctcctcctccttt

SEQ ID NO: 394 - DNA, 16 bp, Artificial sequence
  Synthetic oligonucleotide
gagtccccggctcctc

SEQ ID NO: 395 - DNA, 16 bp, Artificial sequence
  Synthetic oligonucleotide
tcctggcagtgctctc

SEQ ID NO: 396 - DNA, 16 bp, Artificial sequence
  Synthetic oligonucleotide
tggtgggtcctggcag

SEQ ID NO: 397 - DNA, 16 bp, Artificial sequence
  Synthetic oligonucleotide
catcctgcttccagtg

SEQ ID NO: 398 - DNA, 16 bp, Artificial sequence
  Synthetic oligonucleotide
gtcagctccatcctgc

SEQ ID NO: 399 - DNA, 16 bp, Artificial sequence
  Synthetic oligonucleotide
ttccgtagtcagctcc

SEQ ID NO: 400 - DNA, 16 bp, Artificial sequence
  Synthetic oligonucleotide
gagtgtgcagttccgt

SEQ ID NO: 401 - DNA, 16 bp, Artificial sequence
  Synthetic oligonucleotide
gcccactgagtgtgca

SEQ ID NO: 402 - DNA, 16 bp, Artificial sequence
  Synthetic oligonucleotide
gcagaaacagcccact

SEQ ID NO: 403 - DNA, 16 bp, Artificial sequence
  Synthetic oligonucleotide
gaagcatagaacagat

SEQ ID NO: 404 - DNA, 16 bp, Artificial sequence
  Synthetic oligonucleotide
gcacgaggaagcatag

SEQ ID NO: 405 - DNA, 16 bp, Artificial sequence
  Synthetic oligonucleotide
aattggcacgaggaag

SEQ ID NO: 406 - DNA, 16 bp, Artificial sequence
  Synthetic oligonucleotide
ataattggcacgagga

SEQ ID NO: 407 - DNA, 16 bp, Artificial sequence
  Synthetic oligonucleotide
ctataattggcacgag

SEQ ID NO: 408 - DNA, 16 bp, Artificial sequence
  Synthetic oligonucleotide
aactataattggcacg

SEQ ID NO: 409 - DNA, 16 bp, Artificial sequence
  Synthetic oligonucleotide
caaactataattggca

SEQ ID NO: 410 - DNA, 16 bp, Artificial sequence
  Synthetic oligonucleotide
gtcaaactataattgg

SEQ ID NO: 411 - DNA, 16 bp, Artificial sequence
  Synthetic oligonucleotide
ggccctgtcaaactat

SEQ ID NO: 412 - DNA, 16 bp, Artificial sequence
  Synthetic oligonucleotide
attttaaggccctgtc

SEQ ID NO: 413 - DNA, 16 bp, Artificial sequence
  Synthetic oligonucleotide
ccaagtaattttaagg

SEQ ID NO: 414 - DNA, 16 bp, Artificial sequence
  Synthetic oligonucleotide
gcatttggaaaaagcc

SEQ ID NO: 415 - DNA, 16 bp, Artificial sequence
  Synthetic oligonucleotide
ggattctataaataga

SEQ ID NO: 416 - DNA, 16 bp, Artificial sequence
  Synthetic oligonucleotide
gaggtctttgggattc

SEQ ID NO: 417 - DNA, 16 bp, Artificial sequence
  Synthetic oligonucleotide
gcaagtggaggtcttt

SEQ ID NO: 418 - DNA, 16 bp, Artificial sequence
  Synthetic oligonucleotide
tacttaagcaagtgga

SEQ ID NO: 419 - DNA, 16 bp, Artificial sequence
  Synthetic oligonucleotide
ataggtatacttaagc

SEQ ID NO: 420 - DNA, 16 bp, Artificial sequence
  Synthetic oligonucleotide
gtaagtgataggtata

SEQ ID NO: 421 - DNA, 16 bp, Artificial sequence
  Synthetic oligonucleotide
gtactttctcaaaacc

SEQ ID NO: 422 - DNA, 16 bp, Artificial sequence
  Synthetic oligonucleotide
tactgctgtactttct

SEQ ID NO: 423 - DNA, 16 bp, Artificial sequence
  Synthetic oligonucleotide
cccagtctactgctgt

SEQ ID NO: 424 - DNA, 16 bp, Artificial sequence
  Synthetic oligonucleotide
ggcctggaggtgacgc

SEQ ID NO: 425 - DNA, 16 bp, Artificial sequence
  Synthetic oligonucleotide
gagaaacggcctggag

SEQ ID NO: 426 - DNA, 16 bp, Artificial sequence
  Synthetic oligonucleotide
gtagtatgagaaacgg

SEQ ID NO: 427 - DNA, 16 bp, Artificial sequence
  Synthetic oligonucleotide
atatcctgtagtatga

SEQ ID NO: 428 - DNA, 16 bp, Artificial sequence
  Synthetic oligonucleotide
atagtaaatatcctgt

SEQ ID NO: 429 - DNA, 16 bp, Artificial sequence
  Synthetic oligonucleotide
cctgggagtaatagta

SEQ ID NO: 430 - DNA, 16 bp, Artificial sequence
  Synthetic oligonucleotide
tgctgatcctgggagt

SEQ ID NO: 431 - DNA, 16 bp, Artificial sequence
  Synthetic oligonucleotide
aatcttctgctgatcc

SEQ ID NO: 432 - DNA, 16 bp, Artificial sequence
  Synthetic oligonucleotide
gctacgcaatcttctg

SEQ ID NO: 433 - DNA, 16 bp, Artificial sequence
  Synthetic oligonucleotide
acacacatttgagagc

SEQ ID NO: 434 - DNA, 16 bp, Artificial sequence
  Synthetic oligonucleotide
ccattagaaaagcagg

SEQ ID NO: 435 - DNA, 16 bp, Artificial sequence
  Synthetic oligonucleotide
taggtgcttgttgaat

SEQ ID NO: 436 - DNA, 16 bp, Artificial sequence
  Synthetic oligonucleotide
aggcacttactaggtg

SEQ ID NO: 437 - DNA, 16 bp, Artificial sequence
  Synthetic oligonucleotide
gatacagcaggcactt

SEQ ID NO: 438 - DNA, 16 bp, Artificial sequence
  Synthetic oligonucleotide
atgtagggatacagca

SEQ ID NO: 439 - DNA, 16 bp, Artificial sequence
  Synthetic oligonucleotide
ctgtgtaatgtaggga

SEQ ID NO: 440 - DNA, 16 bp, Artificial sequence
  Synthetic oligonucleotide
ggctgaactgtgtaat

SEQ ID NO: 441 - DNA, 16 bp, Artificial sequence
  Synthetic oligonucleotide
tgataaaggctgaact

SEQ ID NO: 442 - DNA, 16 bp, Artificial sequence
  Synthetic oligonucleotide
ctaagcttgataaagg

SEQ ID NO: 443 - DNA, 16 bp, Artificial sequence
  Synthetic oligonucleotide
ctcactgctcactaag

SEQ ID NO: 444 - DNA, 16 bp, Artificial sequence
  Synthetic oligonucleotide
ttcagtgctcactgct

SEQ ID NO: 445 - DNA, 16 bp, Artificial sequence
  Synthetic oligonucleotide
ataatgtttcagtgct

SEQ ID NO: 446 - DNA, 16 bp, Artificial sequence
  Synthetic oligonucleotide
ctgactttaatattag

SEQ ID NO: 447 - DNA, 16 bp, Artificial sequence
  Synthetic oligonucleotide
gtcttttctgtagtta

SEQ ID NO: 448 - DNA, 16 bp, Artificial sequence
  Synthetic oligonucleotide
gttctctactgtttgt

SEQ ID NO: 449 - DNA, 16 bp, Artificial sequence
  Synthetic oligonucleotide
ggagaatttgggctgg

SEQ ID NO: 450 - DNA, 16 bp, Artificial sequence
  Synthetic oligonucleotide
ttagagaggagaattt

SEQ ID NO: 451 - DNA, 16 bp, Artificial sequence
  Synthetic oligonucleotide
gacacttttagagagg

SEQ ID NO: 452 - DNA, 16 bp, Artificial sequence
  Synthetic oligonucleotide
tcttgtggacactttt

SEQ ID NO: 453 - DNA, 16 bp, Artificial sequence
  Synthetic oligonucleotide
caccccttcttgtgga

SEQ ID NO: 454 - DNA, 16 bp, Artificial sequence
  Synthetic oligonucleotide
gaataaacaccccttc

SEQ ID NO: 455 - DNA, 16 bp, Artificial sequence
  Synthetic oligonucleotide
gaaatgtgttggaaga

SEQ ID NO: 456 - DNA, 16 bp, Artificial sequence
  Synthetic oligonucleotide
actccatgaggttttc

SEQ ID NO: 457 - DNA, 16 bp, Artificial sequence
  Synthetic oligonucleotide
tgactccatgaggttt

SEQ ID NO: 458 - DNA, 16 bp, Artificial sequence
  Synthetic oligonucleotide
gatgactccatgaggt

SEQ ID NO: 459 - DNA, 16 bp, Artificial sequence
  Synthetic oligonucleotide
aagatgactccatgag

SEQ ID NO: 460 - DNA, 16 bp, Artificial sequence
  Synthetic oligonucleotide
atgaaagtgtgtgcaa

SEQ ID NO: 461 - DNA, 16 bp, Artificial sequence
  Synthetic oligonucleotide
gcactgcatgaaagtg

SEQ ID NO: 462 - DNA, 16 bp, Artificial sequence
  Synthetic oligonucleotide
ctacaaagagcactgc

SEQ ID NO: 463 - DNA, 16 bp, Artificial sequence
  Synthetic oligonucleotide
ctgttagctacaaaga

SEQ ID NO: 464 - DNA, 16 bp, Artificial sequence
  Synthetic oligonucleotide
atcttcactgttagct

SEQ ID NO: 465 - DNA, 16 bp, Artificial sequence
  Synthetic oligonucleotide
gaggtaaatcttcact

SEQ ID NO: 466 - DNA, 16 bp, Artificial sequence
  Synthetic oligonucleotide
gcagaacgaggtaaat

SEQ ID NO: 467 - DNA, 16 bp, Artificial sequence
  Synthetic oligonucleotide
cctctgagcagaacga

SEQ ID NO: 468 - DNA, 16 bp, Artificial sequence
  Synthetic oligonucleotide
agcaaggcctctgagc

SEQ ID NO: 469 - DNA, 16 bp, Artificial sequence
  Synthetic oligonucleotide
gctccacagcaaggcc

SEQ ID NO: 470 - DNA, 16 bp, Artificial sequence
  Synthetic oligonucleotide
cagtggagctccacag

SEQ ID NO: 471 - DNA, 16 bp, Artificial sequence
  Synthetic oligonucleotide
catggcagtggagctc

SEQ ID NO: 472 - DNA, 16 bp, Artificial sequence
  Synthetic oligonucleotide
tacatggcagtggagc

SEQ ID NO: 473 - DNA, 16 bp, Artificial sequence
  Synthetic oligonucleotide
ggtacatggcagtgga

SEQ ID NO: 474 - DNA, 16 bp, Artificial sequence
  Synthetic oligonucleotide
tgggtacatggcagtg

SEQ ID NO: 475 - DNA, 16 bp, Artificial sequence
  Synthetic oligonucleotide
actgggtacatggcag

SEQ ID NO: 476 - DNA, 16 bp, Artificial sequence
  Synthetic oligonucleotide
ctactgggtacatggc

SEQ ID NO: 477 - DNA, 16 bp, Artificial sequence
  Synthetic oligonucleotide
caaaccctactgggta

SEQ ID NO: 478 - DNA, 16 bp, Artificial sequence
  Synthetic oligonucleotide
gaaatgtcaaacccta

SEQ ID NO: 479 - DNA, 16 bp, Artificial sequence
  Synthetic oligonucleotide
ggctaatgaaatgtca

SEQ ID NO: 480 - DNA, 16 bp, Artificial sequence
  Synthetic oligonucleotide
gttgcatggctaatga

SEQ ID NO: 481 - DNA, 16 bp, Artificial sequence
  Synthetic oligonucleotide
tatccatgttgcatgg

SEQ ID NO: 482 - DNA, 16 bp, Artificial sequence
  Synthetic oligonucleotide
ctgctgcccaatacat

SEQ ID NO: 483 - DNA, 16 bp, Artificial sequence
  Synthetic oligonucleotide
acacagtctgctgccc

SEQ ID NO: 484 - DNA, 16 bp, Artificial sequence
  Synthetic oligonucleotide
tcacgaaacacagtct

SEQ ID NO: 485 - DNA, 16 bp, Artificial sequence
  Synthetic oligonucleotide
ctgcagttcacgaaac

SEQ ID NO: 486 - DNA, 16 bp, Artificial sequence
  Synthetic oligonucleotide
tacatcactgcagttc

SEQ ID NO: 487 - DNA, 16 bp, Artificial sequence
  Synthetic oligonucleotide
agatgtatacatcact

SEQ ID NO: 488 - DNA, 16 bp, Artificial sequence
  Synthetic oligonucleotide
cccaaaatactttgca

SEQ ID NO: 489 - DNA, 16 bp, Artificial sequence
  Synthetic oligonucleotide
gataatataccccaaa

SEQ ID NO: 490 - DNA, 16 bp, Artificial sequence
  Synthetic oligonucleotide
cccttaggataatata

SEQ ID NO: 491 - DNA, 16 bp, Artificial sequence
  Synthetic oligonucleotide
ttatcttcccttagga

SEQ ID NO: 492 - DNA, 16 bp, Artificial sequence
  Synthetic oligonucleotide
gtgaaacagcagttct

SEQ ID NO: 493 - DNA, 16 bp, Artificial sequence
  Synthetic oligonucleotide
gggccccgtgaaacag

SEQ ID NO: 494 - DNA, 16 bp, Artificial sequence
  Synthetic oligonucleotide
caggtaagggccccgt

SEQ ID NO: 495 - DNA, 16 bp, Artificial sequence
  Synthetic oligonucleotide
agggtcacaggtaagg

SEQ ID NO: 496 - DNA, 16 bp, Artificial sequence
  Synthetic oligonucleotide
agcaaagagggtcaca

SEQ ID NO: 497 - DNA, 16 bp, Artificial sequence
  Synthetic oligonucleotide
ggttaaatattcttca

SEQ ID NO: 498 - DNA, 16 bp, Artificial sequence
  Synthetic oligonucleotide
tctttgaagtgctgtg

SEQ ID NO: 499 - DNA, 16 bp, Artificial sequence
  Synthetic oligonucleotide
gacagcttctttgaag

SEQ ID NO: 500 - DNA, 16 bp, Artificial sequence
  Synthetic oligonucleotide
cttccaagacagcttc

SEQ ID NO: 501 - DNA, 16 bp, Artificial sequence
  Synthetic oligonucleotide
agacagacttccaaga

SEQ ID NO: 502 - DNA, 16 bp, Artificial sequence
  Synthetic oligonucleotide
gctcctgagacagact

SEQ ID NO: 503 - DNA, 16 bp, Artificial sequence
  Synthetic oligonucleotide
acagggtgctcctgag

SEQ ID NO: 504 - DNA, 16 bp, Artificial sequence
  Synthetic oligonucleotide
ggagaattaagaagac

SEQ ID NO: 505 - DNA, 16 bp, Artificial sequence
  Synthetic oligonucleotide
agcatccgcttggaga

SEQ ID NO: 506 - DNA, 16 bp, Artificial sequence
  Synthetic oligonucleotide
gaaatggagcatccgc

SEQ ID NO: 507 - DNA, 16 bp, Artificial sequence
  Synthetic oligonucleotide
agcaattgaaatggag

SEQ ID NO: 508 - DNA, 16 bp, Artificial sequence
  Synthetic oligonucleotide
gtcacaaagcaattga

SEQ ID NO: 509 - DNA, 16 bp, Artificial sequence
  Synthetic oligonucleotide
cactgttaaagcagca

SEQ ID NO: 510 - DNA, 16 bp, Artificial sequence
  Synthetic oligonucleotide
tcagctccactgttaa

SEQ ID NO: 511 - DNA, 16 bp, Artificial sequence
  Synthetic oligonucleotide
ggccccagccaagaag

SEQ ID NO: 512 - DNA, 16 bp, Artificial sequence
  Synthetic oligonucleotide
aggtagtggccccagc

SEQ ID NO: 513 - DNA, 16 bp, Artificial sequence
  Synthetic oligonucleotide
gtcaacatacacatag

SEQ ID NO: 514 - DNA, 16 bp, Artificial sequence
  Synthetic oligonucleotide
gatcactcagaatttt

SEQ ID NO: 515 - DNA, 16 bp, Artificial sequence
  Synthetic oligonucleotide
taccctggatcactca

SEQ ID NO: 516 - DNA, 16 bp, Artificial sequence
  Synthetic oligonucleotide
taggtcataccctgga

SEQ ID NO: 517 - DNA, 16 bp, Artificial sequence
  Synthetic oligonucleotide
cattccctaggtcata

SEQ ID NO: 518 - DNA, 16 bp, Artificial sequence
  Synthetic oligonucleotide
agctagttcattccct

SEQ ID NO: 519 - DNA, 16 bp, Artificial sequence
  Synthetic oligonucleotide
atttcatagctagttc

SEQ ID NO: 520 - DNA, 16 bp, Artificial sequence
  Synthetic oligonucleotide
cctgagtatttcatag

SEQ ID NO: 521 - DNA, 16 bp, Artificial sequence
  Synthetic oligonucleotide
tcctaaccctgagtat

SEQ ID NO: 522 - DNA, 16 bp, Artificial sequence
  Synthetic oligonucleotide
acaagtgctaggattc

SEQ ID NO: 523 - DNA, 16 bp, Artificial sequence
  Synthetic oligonucleotide
tcctgagacaagtgct

SEQ ID NO: 524 - DNA, 16 bp, Artificial sequence
  Synthetic oligonucleotide
ttcagagtcctgagac

SEQ ID NO: 525 - DNA, 16 bp, Artificial sequence
  Synthetic oligonucleotide
ccttttcagagtcctg

SEQ ID NO: 526 - DNA, 16 bp, Artificial sequence
  Synthetic oligonucleotide
cgttccttttcagagt

SEQ ID NO: 527 - DNA, 16 bp, Artificial sequence
  Synthetic oligonucleotide
gccgttccttttcaga

SEQ ID NO: 528 - DNA, 16 bp, Artificial sequence
  Synthetic oligonucleotide
aagccgttccttttca

SEQ ID NO: 529 - DNA, 16 bp, Artificial sequence
  Synthetic oligonucleotide
atgaggaagccgttcc

SEQ ID NO: 530 - DNA, 16 bp, Artificial sequence
  Synthetic oligonucleotide
tatcaagacaaggaat

SEQ ID NO: 531 - DNA, 16 bp, Artificial sequence
  Synthetic oligonucleotide
tccactttatcaagac

SEQ ID NO: 532 - DNA, 16 bp, Artificial sequence
  Synthetic oligonucleotide
tctagtttgccaattc

SEQ ID NO: 533 - DNA, 16 bp, Artificial sequence
  Synthetic oligonucleotide
actaaattctagtttg

SEQ ID NO: 534 - DNA, 16 bp, Artificial sequence
  Synthetic oligonucleotide
actgagtacaaactaa

SEQ ID NO: 535 - DNA, 16 bp, Artificial sequence
  Synthetic oligonucleotide
actgtccactgagtac

SEQ ID NO: 536 - DNA, 16 bp, Artificial sequence
  Synthetic oligonucleotide
caacagcactgtccac

SEQ ID NO: 537 - DNA, 16 bp, Artificial sequence
  Synthetic oligonucleotide
aaatcttcaacagcac

SEQ ID NO: 538 - DNA, 16 bp, Artificial sequence
  Synthetic oligonucleotide
agtcctcaaatcttca

SEQ ID NO: 539 - DNA, 16 bp, Artificial sequence
  Synthetic oligonucleotide
ctttaacaagtcctca

SEQ ID NO: 540 - DNA, 16 bp, Artificial sequence
  Synthetic oligonucleotide
cagtgctctttaacaa

SEQ ID NO: 541 - DNA, 16 bp, Artificial sequence
  Synthetic oligonucleotide
tatgacccagtgctct

SEQ ID NO: 542 - DNA, 16 bp, Artificial sequence
  Synthetic oligonucleotide
tttttccatatgaccc

SEQ ID NO: 543 - DNA, 16 bp, Artificial sequence
  Synthetic oligonucleotide
ggagacacatacattt

SEQ ID NO: 544 - DNA, 16 bp, Artificial sequence
  Synthetic oligonucleotide
aatgcacctgggagac

SEQ ID NO: 545 - DNA, 16 bp, Artificial sequence
  Synthetic oligonucleotide
accaagaaatgcacct

SEQ ID NO: 546 - DNA, 16 bp, Artificial sequence
  Synthetic oligonucleotide
caagacataaaccaag

SEQ ID NO: 547 - DNA, 16 bp, Artificial sequence
  Synthetic oligonucleotide
cttgaggttttcctaa

SEQ ID NO: 548 - DNA, 16 bp, Artificial sequence
  Synthetic oligonucleotide
tgcttgaggttttcct

SEQ ID NO: 549 - DNA, 16 bp, Artificial sequence
  Synthetic oligonucleotide
aattactgcttgaggt

SEQ ID NO: 550 - DNA, 16 bp, Artificial sequence
  Synthetic oligonucleotide
gagatattaattactg

SEQ ID NO: 551 - DNA, 16 bp, Artificial sequence
  Synthetic oligonucleotide
gttccaggagatatta

SEQ ID NO: 552 - DNA, 16 bp, Artificial sequence
  Synthetic oligonucleotide
ctatagtgttccagga

SEQ ID NO: 553 - DNA, 16 bp, Artificial sequence
  Synthetic oligonucleotide
tggttctctatagtgt

SEQ ID NO: 554 - DNA, 16 bp, Artificial sequence
  Synthetic oligonucleotide
ggtcacttggttctct

SEQ ID NO: 555 - DNA, 16 bp, Artificial sequence
  Synthetic oligonucleotide
atgagtcggtcacttg

SEQ ID NO: 556 - DNA, 16 bp, Artificial sequence
  Synthetic oligonucleotide
aatgagtcggtcactt

SEQ ID NO: 557 - DNA, 16 bp, Artificial sequence
  Synthetic oligonucleotide
taaatgagtcggtcac

SEQ ID NO: 558 - DNA, 16 bp, Artificial sequence
  Synthetic oligonucleotide
tgtaaatgagtcggtc

SEQ ID NO: 559 - DNA, 16 bp, Artificial sequence
  Synthetic oligonucleotide
gttgtaaatgagtcgg

SEQ ID NO: 560 - DNA, 16 bp, Artificial sequence
  Synthetic oligonucleotide
cagttgtaaatgagtc

SEQ ID NO: 561 - DNA, 16 bp, Artificial sequence
  Synthetic oligonucleotide
ttcagttgtaaatgag

SEQ ID NO: 562 - DNA, 16 bp, Artificial sequence
  Synthetic oligonucleotide
ctaggtttcagttgta

SEQ ID NO: 563 - DNA, 16 bp, Artificial sequence
  Synthetic oligonucleotide
gggcttcctaggtttc

SEQ ID NO: 564 - DNA, 16 bp, Artificial sequence
  Synthetic oligonucleotide
aactctcctgttttcg

SEQ ID NO: 565 - DNA, 16 bp, Artificial sequence
  Synthetic oligonucleotide
ggcgactaactctcct

SEQ ID NO: 566 - DNA, 16 bp, Artificial sequence
  Synthetic oligonucleotide
tctgtagggcgactaa

SEQ ID NO: 567 - DNA, 16 bp, Artificial sequence
  Synthetic oligonucleotide
ctgggttttctgtagg

SEQ ID NO: 568 - DNA, 16 bp, Artificial sequence
  Synthetic oligonucleotide
agtctagctgggtttt

SEQ ID NO: 569 - DNA, 16 bp, Artificial sequence
  Synthetic oligonucleotide
acccaatagtctagct

SEQ ID NO: 570 - DNA, 16 bp, Artificial sequence
  Synthetic oligonucleotide
tctttttagttcatac

SEQ ID NO: 571 - DNA, 16 bp, Artificial sequence
  Synthetic oligonucleotide
gcacagtctcttttta

SEQ ID NO: 572 - DNA, 16 bp, Artificial sequence
  Synthetic oligonucleotide
caccatggcacagtct

SEQ ID NO: 573 - DNA, 16 bp, Artificial sequence
  Synthetic oligonucleotide
tttttctcaccatggc

SEQ ID NO: 574 - DNA, 16 bp, Artificial sequence
  Synthetic oligonucleotide
atttcactgtaggatt

SEQ ID NO: 575 - DNA, 16 bp, Artificial sequence
  Synthetic oligonucleotide
gctgctcatttcactg

SEQ ID NO: 576 - DNA, 16 bp, Artificial sequence
  Synthetic oligonucleotide
tgtaagggctgctcat

SEQ ID NO: 577 - DNA, 16 bp, Artificial sequence
  Synthetic oligonucleotide
acaatactgtaagggc

SEQ ID NO: 578 - DNA, 16 bp, Artificial sequence
  Synthetic oligonucleotide
acctacctgcccttgg

SEQ ID NO: 579 - DNA, 16 bp, Artificial sequence
  Synthetic oligonucleotide
cactaatacctacctg

SEQ ID NO: 580 - DNA, 16 bp, Artificial sequence
  Synthetic oligonucleotide
gctttttcaaacacta

SEQ ID NO: 581 - DNA, 16 bp, Artificial sequence
  Synthetic oligonucleotide
caaagaccagcttttt

SEQ ID NO: 582 - DNA, 16 bp, Artificial sequence
  Synthetic oligonucleotide
cctcgctcaaagacca

SEQ ID NO: 583 - DNA, 16 bp, Artificial sequence
  Synthetic oligonucleotide
tttatgccctcgctca

SEQ ID NO: 584 - DNA, 16 bp, Artificial sequence
  Synthetic oligonucleotide
agctgtatttatgccc

SEQ ID NO: 585 - DNA, 16 bp, Artificial sequence
  Synthetic oligonucleotide
ttgttccacccctggg

SEQ ID NO: 586 - DNA, 16 bp, Artificial sequence
  Synthetic oligonucleotide
ctcccagagttgttcc

SEQ ID NO: 587 - DNA, 16 bp, Artificial sequence
  Synthetic oligonucleotide
acccaagactcccaga

SEQ ID NO: 588 - DNA, 16 bp, Artificial sequence
  Synthetic oligonucleotide
tgcgagtacccaagac

SEQ ID NO: 589 - DNA, 16 bp, Artificial sequence
  Synthetic oligonucleotide
caagaggtgcgagtac

SEQ ID NO: 590 - DNA, 16 bp, Artificial sequence
  Synthetic oligonucleotide
gagcatcaacaaagcc

SEQ ID NO: 591 - DNA, 16 bp, Artificial sequence
  Synthetic oligonucleotide
cctggcggagcatcaa

SEQ ID NO: 592 - DNA, 16 bp, Artificial sequence
  Synthetic oligonucleotide
tggccttcctggcgga

SEQ ID NO: 593 - DNA, 16 bp, Artificial sequence
  Synthetic oligonucleotide
acacaagtggccttcc

SEQ ID NO: 594 - DNA, 16 bp, Artificial sequence
  Synthetic oligonucleotide
ctgaattgttactaaa

SEQ ID NO: 595 - DNA, 16 bp, Artificial sequence
  Synthetic oligonucleotide
actggatctgaattgt

SEQ ID NO: 596 - DNA, 16 bp, Artificial sequence
  Synthetic oligonucleotide
agtttacactggatct

SEQ ID NO: 597 - DNA, 16 bp, Artificial sequence
  Synthetic oligonucleotide
gagcaatgaacggaag

SEQ ID NO: 598 - DNA, 16 bp, Artificial sequence
  Synthetic oligonucleotide
gtgactggagagcaat

SEQ ID NO: 599 - DNA, 16 bp, Artificial sequence
  Synthetic oligonucleotide
aactttcacctgtggg

SEQ ID NO: 600 - DNA, 16 bp, Artificial sequence
  Synthetic oligonucleotide
ccttaaccaatcccaa

SEQ ID NO: 601 - DNA, 16 bp, Artificial sequence
  Synthetic oligonucleotide
ataaagaccttaacca

SEQ ID NO: 602 - DNA, 16 bp, Artificial sequence
  Synthetic oligonucleotide
cgtaatacaaataaag

SEQ ID NO: 603 - DNA, 16 bp, Artificial sequence
  Synthetic oligonucleotide
gatgcagctggccaca

SEQ ID NO: 604 - DNA, 16 bp, Artificial sequence
  Synthetic oligonucleotide
accattcagacagatg

SEQ ID NO: 605 - DNA, 16 bp, Artificial sequence
  Synthetic oligonucleotide
ttcacgcaccattcag

SEQ ID NO: 606 - DNA, 16 bp, Artificial sequence
  Synthetic oligonucleotide
gagagccttcacgcac

SEQ ID NO: 607 - DNA, 16 bp, Artificial sequence
  Synthetic oligonucleotide
aaggtctgagagcctt

SEQ ID NO: 608 - DNA, 16 bp, Artificial sequence
  Synthetic oligonucleotide
ggtgtgtaaggtctga

SEQ ID NO: 609 - DNA, 16 bp, Artificial sequence
  Synthetic oligonucleotide
acaaaatggtgtgtaa

SEQ ID NO: 610 - DNA, 16 bp, Artificial sequence
  Synthetic oligonucleotide
gtaaaacataacttac

SEQ ID NO: 611 - DNA, 16 bp, Artificial sequence
  Synthetic oligonucleotide
tcgagatcagtctcaa

SEQ ID NO: 612 - DNA, 16 bp, Artificial sequence
  Synthetic oligonucleotide
acctgcatcgagatca

SEQ ID NO: 613 - DNA, 16 bp, Artificial sequence
  Synthetic oligonucleotide
caaggagatccacctg

SEQ ID NO: 614 - DNA, 16 bp, Artificial sequence
  Synthetic oligonucleotide
tatcaggatctcaagg

SEQ ID NO: 615 - DNA, 16 bp, Artificial sequence
  Synthetic oligonucleotide
aacaggctatcaggat

SEQ ID NO: 616 - DNA, 16 bp, Artificial sequence
  Synthetic oligonucleotide
ttcctgtaacaggcta

SEQ ID NO: 617 - DNA, 16 bp, Artificial sequence
  Synthetic oligonucleotide
actgacctttacttca

SEQ ID NO: 618 - DNA, 16 bp, Artificial sequence
  Synthetic oligonucleotide
cctcaaagctgtgaaa

SEQ ID NO: 619 - DNA, 16 bp, Artificial sequence
  Synthetic oligonucleotide
gcatgttcctcaaagc

SEQ ID NO: 620 - DNA, 16 bp, Artificial sequence
  Synthetic oligonucleotide
ttcttatgcatgttcc

SEQ ID NO: 621 - DNA, 16 bp, Artificial sequence
  Synthetic oligonucleotide
gctacatttcttatgc

SEQ ID NO: 622 - DNA, 16 bp, Artificial sequence
  Synthetic oligonucleotide
ctacttcagctacatt

SEQ ID NO: 623 - DNA, 16 bp, Artificial sequence
  Synthetic oligonucleotide
gtcccctctacttcag

SEQ ID NO: 624 - DNA, 16 bp, Artificial sequence
  Synthetic oligonucleotide
tggcccttctctcacg

SEQ ID NO: 625 - DNA, 16 bp, Artificial sequence
  Synthetic oligonucleotide
gccggcctggcccttc

SEQ ID NO: 626 - DNA, 16 bp, Artificial sequence
  Synthetic oligonucleotide
ttggcctgccggcctg

SEQ ID NO: 627 - DNA, 16 bp, Artificial sequence
  Synthetic oligonucleotide
aggagggttggcctgc

SEQ ID NO: 628 - DNA, 16 bp, Artificial sequence
  Synthetic oligonucleotide
ccattggaggagggtt

SEQ ID NO: 629 - DNA, 16 bp, Artificial sequence
  Synthetic oligonucleotide
aatttccattggagga

SEQ ID NO: 630 - DNA, 16 bp, Artificial sequence
  Synthetic oligonucleotide
ggaatttccattggag

SEQ ID NO: 631 - DNA, 16 bp, Artificial sequence
  Synthetic oligonucleotide
cgggaatttccattgg

SEQ ID NO: 632 - DNA, 16 bp, Artificial sequence
  Synthetic oligonucleotide
cacgggaatttccatt

SEQ ID NO: 633 - DNA, 16 bp, Artificial sequence
  Synthetic oligonucleotide
aacacgggaatttcca

SEQ ID NO: 634 - DNA, 16 bp, Artificial sequence
  Synthetic oligonucleotide
gcaacacgggaatttc

SEQ ID NO: 635 - DNA, 16 bp, Artificial sequence
  Synthetic oligonucleotide
gtctcagtttgaagca

SEQ ID NO: 636 - DNA, 16 bp, Artificial sequence
  Synthetic oligonucleotide
cccatctgtctcagtt

SEQ ID NO: 637 - DNA, 16 bp, Artificial sequence
  Synthetic oligonucleotide
gttaagtcccatctgt

SEQ ID NO: 638 - DNA, 16 bp, Artificial sequence
  Synthetic oligonucleotide
attgcctgttaagtcc

SEQ ID NO: 639 - DNA, 16 bp, Artificial sequence
  Synthetic oligonucleotide
ggcagttctttcagca

SEQ ID NO: 640 - DNA, 16 bp, Artificial sequence
  Synthetic oligonucleotide
acctgctggcagttct

SEQ ID NO: 641 - DNA, 16 bp, Artificial sequence
  Synthetic oligonucleotide
gggtcctacctgctgg

SEQ ID NO: 642 - DNA, 16 bp, Artificial sequence
  Synthetic oligonucleotide
caagctttcatttggg

SEQ ID NO: 643 - DNA, 16 bp, Artificial sequence
  Synthetic oligonucleotide
ggaaattcaagctttc

SEQ ID NO: 644 - DNA, 16 bp, Artificial sequence
  Synthetic oligonucleotide
acgcagagccagtagg

SEQ ID NO: 645 - DNA, 16 bp, Artificial sequence
  Synthetic oligonucleotide
aaacgcagagccagta

SEQ ID NO: 646 - DNA, 16 bp, Artificial sequence
  Synthetic oligonucleotide
caaaacgcagagccag

SEQ ID NO: 647 - DNA, 16 bp, Artificial sequence
  Synthetic oligonucleotide
tcctttcctacagatc

SEQ ID NO: 648 - DNA, 16 bp, Artificial sequence
  Synthetic oligonucleotide
gtgaagcatcctttcc

SEQ ID NO: 649 - DNA, 16 bp, Artificial sequence
  Synthetic oligonucleotide
tcagtttgtgaagcat

SEQ ID NO: 650 - DNA, 16 bp, Artificial sequence
  Synthetic oligonucleotide
atctacctcagtttgt

SEQ ID NO: 651 - DNA, 16 bp, Artificial sequence
  Synthetic oligonucleotide
tagcattatctacctc

SEQ ID NO: 652 - DNA, 16 bp, Artificial sequence
  Synthetic oligonucleotide
gacagcatagcattat

SEQ ID NO: 653 - DNA, 16 bp, Artificial sequence
  Synthetic oligonucleotide
taccaacgacagcata

SEQ ID NO: 654 - DNA, 16 bp, Artificial sequence
  Synthetic oligonucleotide
tgatgtataccaacga

SEQ ID NO: 655 - DNA, 16 bp, Artificial sequence
  Synthetic oligonucleotide
gcagagcaatttacat

SEQ ID NO: 656 - DNA, 16 bp, Artificial sequence
  Synthetic oligonucleotide
ttgctttgcagagcaa

SEQ ID NO: 657 - DNA, 16 bp, Artificial sequence
  Synthetic oligonucleotide
cttaagctaaactcct

SEQ ID NO: 658 - DNA, 16 bp, Artificial sequence
  Synthetic oligonucleotide
atgacgacttaagcta

SEQ ID NO: 659 - DNA, 16 bp, Artificial sequence
  Synthetic oligonucleotide
atattagagactgtat

SEQ ID NO: 660 - DNA, 16 bp, Artificial sequence
  Synthetic oligonucleotide
ctccatcaatcatgat

SEQ ID NO: 661 - DNA, 16 bp, Artificial sequence
  Synthetic oligonucleotide
gaatgctctccatcaa

SEQ ID NO: 662 - DNA, 16 bp, Artificial sequence
  Synthetic oligonucleotide
gcaagctgaatgctct

SEQ ID NO: 663 - DNA, 16 bp, Artificial sequence
  Synthetic oligonucleotide
atctaaggcaagctga

SEQ ID NO: 664 - DNA, 16 bp, Artificial sequence
  Synthetic oligonucleotide
ttacagcatctaaggc

SEQ ID NO: 665 - DNA, 16 bp, Artificial sequence
  Synthetic oligonucleotide
aatgttcagcttttcc

SEQ ID NO: 666 - DNA, 16 bp, Artificial sequence
  Synthetic oligonucleotide
acgccttaatgttcag

SEQ ID NO: 667 - DNA, 16 bp, Artificial sequence
  Synthetic oligonucleotide
gacttcgggagatacg

SEQ ID NO: 668 - DNA, 16 bp, Artificial sequence
  Synthetic oligonucleotide
cacagaggacttcggg

SEQ ID NO: 669 - DNA, 16 bp, Artificial sequence
  Synthetic oligonucleotide
cccttcccgctccgaa

SEQ ID NO: 670 - DNA, 16 bp, Artificial sequence
  Synthetic oligonucleotide
aggctcgggcagagcc

SEQ ID NO: 671 - DNA, 16 bp, Artificial sequence
  Synthetic oligonucleotide
gagcaccgcgccggag

SEQ ID NO: 672 - DNA, 16 bp, Artificial sequence
  Synthetic oligonucleotide
atgtggagctcctcct

SEQ ID NO: 673 - DNA, 16 bp, Artificial sequence
  Synthetic oligonucleotide
gccccgaataggaccc

SEQ ID NO: 674 - DNA, 16 bp, Artificial sequence
  Synthetic oligonucleotide
ccgggttcctccaccc

SEQ ID NO: 675 - DNA, 16 bp, Artificial sequence
  Synthetic oligonucleotide
cctggcggcctccacg

SEQ ID NO: 676 - DNA, 16 bp, Artificial sequence
  Synthetic oligonucleotide
aggctcctacccgcct

SEQ ID NO: 677 - DNA, 16 bp, Artificial sequence
  Synthetic oligonucleotide
tgccgtgtcagggtcg

SEQ ID NO: 678 - DNA, 16 bp, Artificial sequence
  Synthetic oligonucleotide
gagtctttgaggctgc

SEQ ID NO: 679 - DNA, 16 bp, Artificial sequence
  Synthetic oligonucleotide
acaggcgcggacgcac

SEQ ID NO: 680 - DNA, 16 bp, Artificial sequence
  Synthetic oligonucleotide
cgagaagagaggctga

SEQ ID NO: 681 - DNA, 16 bp, Artificial sequence
  Synthetic oligonucleotide
gacacattttctgggt

SEQ ID NO: 682 - DNA, 16 bp, Artificial sequence
  Synthetic oligonucleotide
gatgctcagaatgaag

SEQ ID NO: 683 - DNA, 16 bp, Artificial sequence
  Synthetic oligonucleotide
ctatgctgaaccccac

SEQ ID NO: 684 - DNA, 16 bp, Artificial sequence
  Synthetic oligonucleotide
aattctcctatgctga

SEQ ID NO: 685 - DNA, 16 bp, Artificial sequence
  Synthetic oligonucleotide
agtgatgagatattcc

SEQ ID NO: 686 - DNA, 16 bp, Artificial sequence
  Synthetic oligonucleotide
tccagatgcagattcc

SEQ ID NO: 687 - DNA, 16 bp, Artificial sequence
  Synthetic oligonucleotide
tcacctgaaggatttg

SEQ ID NO: 688 - DNA, 16 bp, Artificial sequence
  Synthetic oligonucleotide
atgcataacacggtgt

SEQ ID NO: 689 - DNA, 16 bp, Artificial sequence
  Synthetic oligonucleotide
acacagcctcgccctc

SEQ ID NO: 690 - DNA, 16 bp, Artificial sequence
  Synthetic oligonucleotide
agcaccgtgtggaaag

SEQ ID NO: 691 - DNA, 16 bp, Artificial sequence
  Synthetic oligonucleotide
accctccccaacttaa

SEQ ID NO: 692 - DNA, 16 bp, Artificial sequence
  Synthetic oligonucleotide
ctggcaccaaaagtac

SEQ ID NO: 693 - DNA, 16 bp, Artificial sequence
  Synthetic oligonucleotide
actggcattgagacgg

SEQ ID NO: 694 - DNA, 16 bp, Artificial sequence
  Synthetic oligonucleotide
cactggcattgagacg

SEQ ID NO: 695 - DNA, 16 bp, Artificial sequence
  Synthetic oligonucleotide
gcactggcattgagac

SEQ ID NO: 696 - DNA, 16 bp, Artificial sequence
  Synthetic oligonucleotide
aagcactggcattgag

SEQ ID NO: 697 - DNA, 16 bp, Artificial sequence
  Synthetic oligonucleotide
gaagcactggcattga

SEQ ID NO: 698 - DNA, 16 bp, Artificial sequence
  Synthetic oligonucleotide
agaagcactggcattg

SEQ ID NO: 699 - DNA, 16 bp, Artificial sequence
  Synthetic oligonucleotide
ataagaagcactggca

SEQ ID NO: 700 - DNA, 16 bp, Artificial sequence
  Synthetic oligonucleotide
gataagaagcactggc

SEQ ID NO: 701 - DNA, 16 bp, Artificial sequence
  Synthetic oligonucleotide
gagataagaagcactg

SEQ ID NO: 702 - DNA, 16 bp, Artificial sequence
  Synthetic oligonucleotide
ctgagataagaagcac

SEQ ID NO: 703 - DNA, 16 bp, Artificial sequence
  Synthetic oligonucleotide
ggtaaaggagtgcagg

SEQ ID NO: 704 - DNA, 16 bp, Artificial sequence
  Synthetic oligonucleotide
actggcatcgagacgg

SEQ ID NO: 705 - DNA, 16 bp, Artificial sequence
  Synthetic oligonucleotide
cactggcatcgagacg

SEQ ID NO: 706 - DNA, 16 bp, Artificial sequence
  Synthetic oligonucleotide
agcactggcatcgaga

SEQ ID NO: 707 - DNA, 16 bp, Artificial sequence
  Synthetic oligonucleotide
aagcactggcatcgag

SEQ ID NO: 708 - DNA, 16 bp, Artificial sequence
  Synthetic oligonucleotide
ggaagcactggcatcg

SEQ ID NO: 709 - DNA, 16 bp, Artificial sequence
  Synthetic oligonucleotide
ataggaagcactggca

SEQ ID NO: 710 - DNA, 16 bp, Artificial sequence
  Synthetic oligonucleotide
gataggaagcactggc

SEQ ID NO: 711 - DNA, 16 bp, Artificial sequence
  Synthetic oligonucleotide
agataggaagcactgg

SEQ ID NO: 712 - DNA, 16 bp, Artificial sequence
  Synthetic oligonucleotide
gagataggaagcactg

SEQ ID NO: 713 - DNA, 16 bp, Artificial sequence
  Synthetic oligonucleotide
tgagataggaagcact

SEQ ID NO: 714 - DNA, 16 bp, Artificial sequence
  Synthetic oligonucleotide
ctgagataggaagcac

SEQ ID NO: 715 - DNA, 16 bp, Artificial sequence
  Synthetic oligonucleotide
ggatgccaccatccca

SEQ ID NO: 716 - DNA, 16 bp, Artificial sequence
  Synthetic oligonucleotide
ggagtgatctctgtgg

SEQ ID NO: 717 - DNA, 16 bp, Artificial sequence
  Synthetic oligonucleotide
gtaggtaggcacctgt

SEQ ID NO: 718 - DNA, 16 bp, Artificial sequence
  Synthetic oligonucleotide
gagggagctcattttg

SEQ ID NO: 719 - DNA, 16 bp, Artificial sequence
  Synthetic oligonucleotide
aaaggccaaattgcaa

SEQ ID NO: 720 - DNA, 16 bp, Artificial sequence
  Synthetic oligonucleotide
ctgcagccaaggataa

SEQ ID NO: 721 - DNA, 16 bp, Artificial sequence
  Synthetic oligonucleotide
ggcgcgctcccttccc

SEQ ID NO: 722 - DNA, 16 bp, Artificial sequence
  Synthetic oligonucleotide
cccttccccgcgactc

SEQ ID NO: 723 - DNA, 16 bp, Artificial sequence
  Synthetic oligonucleotide
ttgccttcgctcactc

SEQ ID NO: 724 - DNA, 16 bp, Artificial sequence
  Synthetic oligonucleotide
aggcgcggacgcacgg

SEQ ID NO: 725 - DNA, 16 bp, Artificial sequence
  Synthetic oligonucleotide
ctaccttttttggctc

SEQ ID NO: 726 - DNA, 16 bp, Artificial sequence
  Synthetic oligonucleotide
tgccttgtgacataaa

SEQ ID NO: 727 - DNA, 16 bp, Artificial sequence
  Synthetic oligonucleotide
atattccaacaggcgg

SEQ ID NO: 728 - DNA, 16 bp, Artificial sequence
  Synthetic oligonucleotide
tgaacccttcatcaga

SEQ ID NO: 729 - DNA, 16 bp, Artificial sequence
  Synthetic oligonucleotide
agaccaggattcgcca

SEQ ID NO: 730 - DNA, 16 bp, Artificial sequence
  Synthetic oligonucleotide
cactacctgcagccaa

SEQ ID NO: 731 - DNA, 16 bp, Artificial sequence
  Synthetic oligonucleotide
agagtggtacacctct

SEQ ID NO: 732 - DNA, 16 bp, Artificial sequence
  Synthetic oligonucleotide
gtctctacctactcca

SEQ ID NO: 733 - DNA, 16 bp, Artificial sequence
  Synthetic oligonucleotide
aacacctgatcttgct

SEQ ID NO: 734 - DNA, 16 bp, Artificial sequence
  Synthetic oligonucleotide
accatgttcctgaaga

SEQ ID NO: 735 - DNA, 16 bp, Artificial sequence
  Synthetic oligonucleotide
ctcttgtgaggcaaag

SEQ ID NO: 736 - DNA, 16 bp, Artificial sequence
  Synthetic oligonucleotide
gcgcccaatcaccttc

SEQ ID NO: 737 - DNA, 16 bp, Artificial sequence
  Synthetic oligonucleotide
atcgaatctgcccaaa

SEQ ID NO: 738 - DNA, 16 bp, Artificial sequence
  Synthetic oligonucleotide
aaagtcccatcgaatc

SEQ ID NO: 739 - DNA, 16 bp, Artificial sequence
  Synthetic oligonucleotide
caaagcaagtgtctaa

SEQ ID NO: 740 - DNA, 16 bp, Artificial sequence
  Synthetic oligonucleotide
ctcacacacaggatgt

SEQ ID NO: 741 - DNA, 16 bp, Artificial sequence
  Synthetic oligonucleotide
gaggaggaggacttat

SEQ ID NO: 742 - DNA, 16 bp, Artificial sequence
  Synthetic oligonucleotide
tattactcttaggcac

SEQ ID NO: 743 - DNA, 16 bp, Artificial sequence
  Synthetic oligonucleotide
gtgccttctttatagt

SEQ ID NO: 744 - DNA, 16 bp, Artificial sequence
  Synthetic oligonucleotide
ctagaggtgccttctt

SEQ ID NO: 745 - DNA, 16 bp, Artificial sequence
  Synthetic oligonucleotide
tgccagagggcaagat

SEQ ID NO: 746 - DNA, 16 bp, Artificial sequence
  Synthetic oligonucleotide
gctgtttatttcctac

SEQ ID NO: 747 - DNA, 16 bp, Artificial sequence
  Synthetic oligonucleotide
cgagatataaatagct

SEQ ID NO: 748 - DNA, 16 bp, Artificial sequence
  Synthetic oligonucleotide
gccgagatataaatag

SEQ ID NO: 749 - DNA, 16 bp, Artificial sequence
  Synthetic oligonucleotide
gcaggtttcatttcat

SEQ ID NO: 750 - DNA, 16 bp, Artificial sequence
  Synthetic oligonucleotide
gggcaggtttcatttc

SEQ ID NO: 751 - DNA, 16 bp, Artificial sequence
  Synthetic oligonucleotide
agagtgggtgttggcc

SEQ ID NO: 752 - DNA, 16 bp, Artificial sequence
  Synthetic oligonucleotide
atggaaccccaaaatc

SEQ ID NO: 753 - DNA, 16 bp, Artificial sequence
  Synthetic oligonucleotide
gctgccactggtaact

SEQ ID NO: 754 - DNA, 16 bp, Artificial sequence
  Synthetic oligonucleotide
tcgcccatgagttgaa

SEQ ID NO: 755 - DNA, 16 bp, Artificial sequence
  Synthetic oligonucleotide
agttcatgtaaagtct

SEQ ID NO: 756 - DNA, 16 bp, Artificial sequence
  Synthetic oligonucleotide
tcggtccacatacctg

SEQ ID NO: 757 - DNA, 16 bp, Artificial sequence
  Synthetic oligonucleotide
cttggagaagtcccgt

SEQ ID NO: 758 - DNA, 16 bp, Artificial sequence
  Synthetic oligonucleotide
cctgtggtggaactct

SEQ ID NO: 759 - DNA, 16 bp, Artificial sequence
  Synthetic oligonucleotide
aagaggcgactgctga

SEQ ID NO: 760 - DNA, 16 bp, Artificial sequence
  Synthetic oligonucleotide
actgttttaagaggcg

SEQ ID NO: 761 - DNA, 16 bp, Artificial sequence
  Synthetic oligonucleotide
atagtgcaatgaaatg

SEQ ID NO: 762 - DNA, 16 bp, Artificial sequence
  Synthetic oligonucleotide
gggaacctgaaaagag

SEQ ID NO: 763 - DNA, 16 bp, Artificial sequence
  Synthetic oligonucleotide
gaggttcgctgaattg

SEQ ID NO: 764 - DNA, 16 bp, Artificial sequence
  Synthetic oligonucleotide
atctggatgagcttac

SEQ ID NO: 765 - DNA, 16 bp, Artificial sequence
  Synthetic oligonucleotide
agcttagttatctggg

SEQ ID NO: 766 - DNA, 16 bp, Artificial sequence
  Synthetic oligonucleotide
gaacaccatgcccaac

SEQ ID NO: 767 - DNA, 16 bp, Artificial sequence
  Synthetic oligonucleotide
gagctcttccagatcc

SEQ ID NO: 768 - DNA, 16 bp, Artificial sequence
  Synthetic oligonucleotide
tagtcgcgcaagtcta

SEQ ID NO: 769 - DNA, 16 bp, Artificial sequence
  Synthetic oligonucleotide
atccttaattatgcag

SEQ ID NO: 770 - DNA, 16 bp, Artificial sequence
  Synthetic oligonucleotide
gtgtttggtgggaatc

SEQ ID NO: 771 - DNA, 16 bp, Artificial sequence
  Synthetic oligonucleotide
ctaacttacaggacta

SEQ ID NO: 772 - DNA, 16 bp, Artificial sequence
  Synthetic oligonucleotide
tagtgctgtgcagacc

SEQ ID NO: 773 - DNA, 16 bp, Artificial sequence
  Synthetic oligonucleotide
gggctgtccctagtgc

SEQ ID NO: 774 - DNA, 16 bp, Artificial sequence
  Synthetic oligonucleotide
aatgtcacgcccgcaa

SEQ ID NO: 775 - DNA, 16 bp, Artificial sequence
  Synthetic oligonucleotide
ggcctcccgcttgtgg

SEQ ID NO: 776 - DNA, 16 bp, Artificial sequence
  Synthetic oligonucleotide
gaacagtaacttgact

SEQ ID NO: 777 - DNA, 16 bp, Artificial sequence
  Synthetic oligonucleotide
aactctgagtagactt

SEQ ID NO: 778 - DNA, 16 bp, Artificial sequence
  Synthetic oligonucleotide
gagcaccagccatcgg

SEQ ID NO: 779 - DNA, 16 bp, Artificial sequence
  Synthetic oligonucleotide
gaccaatttatgccat

SEQ ID NO: 780 - DNA, 16 bp, Artificial sequence
  Synthetic oligonucleotide
cacgcaatggcaaaag

SEQ ID NO: 781 - DNA, 16 bp, Artificial sequence
  Synthetic oligonucleotide
tcctttgggtgctttc

SEQ ID NO: 782 - DNA, 16 bp, Artificial sequence
  Synthetic oligonucleotide
ctcttactccgctgag

SEQ ID NO: 783 - DNA, 16 bp, Artificial sequence
  Synthetic oligonucleotide
acacaccaggttaaac

SEQ ID NO: 784 - DNA, 16 bp, Artificial sequence
  Synthetic oligonucleotide
agtgtaactgaggact

SEQ ID NO: 785 - DNA, 16 bp, Artificial sequence
  Synthetic oligonucleotide
tgttacttgccacagt

SEQ ID NO: 786 - DNA, 16 bp, Artificial sequence
  Synthetic oligonucleotide
atgcaagcccgttaat

SEQ ID NO: 787 - DNA, 16 bp, Artificial sequence
  Synthetic oligonucleotide
atgagaactttgatgt

SEQ ID NO: 788 - DNA, 16 bp, Artificial sequence
  Synthetic oligonucleotide
aagtcaatcactggag

SEQ ID NO: 789 - DNA, 16 bp, Artificial sequence
  Synthetic oligonucleotide
ttagcaattcctgttg

SEQ ID NO: 790 - DNA, 16 bp, Artificial sequence
  Synthetic oligonucleotide
gctaactggcctcaaa

SEQ ID NO: 791 - DNA, 16 bp, Artificial sequence
  Synthetic oligonucleotide
cttcatttactgttac

SEQ ID NO: 792 - DNA, 16 bp, Artificial sequence
  Synthetic oligonucleotide
caacagagctgagagt

SEQ ID NO: 793 - DNA, 16 bp, Artificial sequence
  Synthetic oligonucleotide
ctcacgagcacctcag

SEQ ID NO: 794 - DNA, 16 bp, Artificial sequence
  Synthetic oligonucleotide
cttgtctcccccagag

SEQ ID NO: 795 - DNA, 16 bp, Artificial sequence
  Synthetic oligonucleotide
ccacctccattctaac

SEQ ID NO: 796 - DNA, 16 bp, Artificial sequence
  Synthetic oligonucleotide
gagccgccacatcagc

SEQ ID NO: 797 - DNA, 16 bp, Artificial sequence
  Synthetic oligonucleotide
ccaccctccgtctcac

SEQ ID NO: 798 - DNA, 16 bp, Artificial sequence
  Synthetic oligonucleotide
tatagcactctcctat

SEQ ID NO: 799 - DNA, 16 bp, Artificial sequence
  Synthetic oligonucleotide
caagacaaatcttctg

SEQ ID NO: 800 - DNA, 16 bp, Artificial sequence
  Synthetic oligonucleotide
tatgccatggacaagt

SEQ ID NO: 801 - DNA, 16 bp, Artificial sequence
  Synthetic oligonucleotide
ccaggttaaacaggaa

SEQ ID NO: 802 - DNA, 16 bp, Artificial sequence
  Synthetic oligonucleotide
gacttaattctgggtt

SEQ ID NO: 803 - DNA, 16 bp, Artificial sequence
  Synthetic oligonucleotide
actgagatatcctgca

SEQ ID NO: 804 - DNA, 16 bp, Artificial sequence
  Synthetic oligonucleotide
aactgagagtgcgagg

SEQ ID NO: 805 - DNA, 16 bp, Artificial sequence
  Synthetic oligonucleotide
aaacagtgcccaagcc

SEQ ID NO: 806 - DNA, 16 bp, Artificial sequence
  Synthetic oligonucleotide
catcatgtagttgtga

SEQ ID NO: 807 - DNA, 16 bp, Artificial sequence
  Synthetic oligonucleotide
tgtcaaagagcttgca

SEQ ID NO: 808 - DNA, 16 bp, Artificial sequence
  Synthetic oligonucleotide
gctgatgtgttctggt

SEQ ID NO: 809 - DNA, 16 bp, Artificial sequence
  Synthetic oligonucleotide
cagtaagagggcagtc

SEQ ID NO: 810 - DNA, 16 bp, Artificial sequence
  Synthetic oligonucleotide
catcacttggtcaatt

SEQ ID NO: 811 - DNA, 16 bp, Artificial sequence
  Synthetic oligonucleotide
cctacaagcagtcatc

SEQ ID NO: 812 - DNA, 16 bp, Artificial sequence
  Synthetic oligonucleotide
ctacaggcacggcttc

SEQ ID NO: 813 - DNA, 16 bp, Artificial sequence
  Synthetic oligonucleotide
tactagattgtaggac

SEQ ID NO: 814 - DNA, 16 bp, Artificial sequence
  Synthetic oligonucleotide
caacagttcaagtatt

SEQ ID NO: 815 - DNA, 16 bp, Artificial sequence
  Synthetic oligonucleotide
ttccagtggtgggtcc

SEQ ID NO: 816 - DNA, 16 bp, Artificial sequence
  Synthetic oligonucleotide
caagtggaggtctttg

SEQ ID NO: 817 - DNA, 16 bp, Artificial sequence
  Synthetic oligonucleotide
atgagaaacggcctgg

SEQ ID NO: 818 - DNA, 16 bp, Artificial sequence
  Synthetic oligonucleotide
aatgtagggatacagc

SEQ ID NO: 819 - DNA, 16 bp, Artificial sequence
  Synthetic oligonucleotide
aataaacaccccttct

SEQ ID NO: 820 - DNA, 16 bp, Artificial sequence
  Synthetic oligonucleotide
ctccacagcaaggcct

SEQ ID NO: 821 - DNA, 16 bp, Artificial sequence
  Synthetic oligonucleotide
gttcacgaaacacagt

SEQ ID NO: 822 - DNA, 16 bp, Artificial sequence
  Synthetic oligonucleotide
caaagagggtcacagg

SEQ ID NO: 823 - DNA, 16 bp, Artificial sequence
  Synthetic oligonucleotide
ccctaggtcataccct

SEQ ID NO: 824 - DNA, 16 bp, Artificial sequence
  Synthetic oligonucleotide
cttcaacagcactgtc

SEQ ID NO: 825 - DNA, 16 bp, Artificial sequence
  Synthetic oligonucleotide
ctgtagggcgactaac

SEQ ID NO: 826 - DNA, 16 bp, Artificial sequence
  Synthetic oligonucleotide
ctaatacctacctgcc

SEQ ID NO: 827 - DNA, 16 bp, Artificial sequence
  Synthetic oligonucleotide
gcacacacaagtggcc

SEQ ID NO: 828 - DNA, 16 bp, Artificial sequence
  Synthetic oligonucleotide
agcaatgaacggaagt

SEQ ID NO: 829 - DNA, 16 bp, Artificial sequence
  Synthetic oligonucleotide
ggctatcaggatctca

SEQ ID NO: 830 - DNA, 16 bp, Artificial sequence
  Synthetic oligonucleotide
ccccattgcctgttaa

SEQ ID NO: 831 - DNA, 16 bp, Artificial sequence
  Synthetic oligonucleotide
acagcatagcattatc

SEQ ID NO: 832 - DNA, 16 bp, Artificial sequence
  Synthetic oligonucleotide
gacgacttaagctaaa

SEQ ID NO: 833 - DNA, 16 bp, Artificial sequence
  Synthetic oligonucleotide
atttacagcatctaag

SEQ ID NO: 834 - DNA, 16 bp, Artificial sequence
  Synthetic oligonucleotide
gctcatcccgtccagc

SEQ ID NO: 835 - DNA, 16 bp, Artificial sequence
  Synthetic oligonucleotide
ggagagcggaggcggg

SEQ ID NO: 836 - DNA, 16 bp, Artificial sequence
  Synthetic oligonucleotide
ctccacgcgcggagga

SEQ ID NO: 837 - DNA, 16 bp, Artificial sequence
  Synthetic oligonucleotide
gggcaccccgccccga

SEQ ID NO: 838 - DNA, 16 bp, Artificial sequence
  Synthetic oligonucleotide
gcacggacgaacgcgc

SEQ ID NO: 839 - DNA, 16 bp, Artificial sequence
  Synthetic oligonucleotide
acgaaaacagccgccg

SEQ ID NO: 840 - DNA, 16 bp, Artificial sequence
  Synthetic oligonucleotide
gagcaaattgagacca

SEQ ID NO: 841 - DNA, 16 bp, Artificial sequence
  Synthetic oligonucleotide
gcgcataggtccttca

SEQ ID NO: 842 - DNA, 16 bp, Artificial sequence
  Synthetic oligonucleotide
ccacataactcaggca

SEQ ID NO: 843 - DNA, 16 bp, Artificial sequence
  Synthetic oligonucleotide
atgagatattcctctc

SEQ ID NO: 844 - DNA, 16 bp, Artificial sequence
  Synthetic oligonucleotide
cagcaactcccttggg

SEQ ID NO: 845 - DNA, 16 bp, Artificial sequence
  Synthetic oligonucleotide
caacaggcggacacgc

SEQ ID NO: 846 - DNA, 16 bp, Artificial sequence
  Synthetic oligonucleotide
atggagatacttgtac

SEQ ID NO: 847 - DNA, 16 bp, Artificial sequence
  Synthetic oligonucleotide
gctgagataagaagca

SEQ ID NO: 848 - DNA, 16 bp, Artificial sequence
  Synthetic oligonucleotide
gcacacgcagcctcta

SEQ ID NO: 849 - DNA, 16 bp, Artificial sequence
  Synthetic oligonucleotide
ccactattcgagagaa

SEQ ID NO: 850 - DNA, 16 bp, Artificial sequence
  Synthetic oligonucleotide
cctgaacatgactggg

SEQ ID NO: 851 - DNA, 16 bp, Artificial sequence
  Synthetic oligonucleotide
gaatttcaggagctag

SEQ ID NO: 852 - DNA, 16 bp, Artificial sequence
  Synthetic oligonucleotide
gcacagaacacctgat

SEQ ID NO: 853 - DNA, 16 bp, Artificial sequence
  Synthetic oligonucleotide
agctgatggagaaacg

SEQ ID NO: 854 - DNA, 16 bp, Artificial sequence
  Synthetic oligonucleotide
ctaaatcaccctggtc

SEQ ID NO: 855 - DNA, 16 bp, Artificial sequence
  Synthetic oligonucleotide
gaactaatgtccccag

SEQ ID NO: 856 - DNA, 16 bp, Artificial sequence
  Synthetic oligonucleotide
gagaattccaaacctt

SEQ ID NO: 857 - DNA, 16 bp, Artificial sequence
  Synthetic oligonucleotide
gtcttaggtgttcaag

SEQ ID NO: 858 - DNA, 16 bp, Artificial sequence
  Synthetic oligonucleotide
cagcaggttttgagac

SEQ ID NO: 859 - DNA, 16 bp, Artificial sequence
  Synthetic oligonucleotide
catgtaaagtctgctg

SEQ ID NO: 860 - DNA, 16 bp, Artificial sequence
  Synthetic oligonucleotide
atataacggtgtttca

SEQ ID NO: 861 - DNA, 16 bp, Artificial sequence
  Synthetic oligonucleotide
acccatttaatctgtc

SEQ ID NO: 862 - DNA, 16 bp, Artificial sequence
  Synthetic oligonucleotide
cattctaacagataac

SEQ ID NO: 863 - DNA, 16 bp, Artificial sequence
  Synthetic oligonucleotide
acacacctgacaacca

SEQ ID NO: 864 - DNA, 16 bp, Artificial sequence
  Synthetic oligonucleotide
gcatgacagggcgagg

SEQ ID NO: 865 - DNA, 16 bp, Artificial sequence
  Synthetic oligonucleotide
tgctttgggcaccaaa

SEQ ID NO: 866 - DNA, 16 bp, Artificial sequence
  Synthetic oligonucleotide
gcccagcaagaggcac

SEQ ID NO: 867 - DNA, 16 bp, Artificial sequence
  Synthetic oligonucleotide
tagataacatgagagt

SEQ ID NO: 868 - DNA, 16 bp, Artificial sequence
  Synthetic oligonucleotide
caaatgacttagtcag

SEQ ID NO: 869 - DNA, 16 bp, Artificial sequence
  Synthetic oligonucleotide
gtcacgcccgcaaaag

SEQ ID NO: 870 - DNA, 16 bp, Artificial sequence
  Synthetic oligonucleotide
ggatggaacagtaact

SEQ ID NO: 871 - DNA, 16 bp, Artificial sequence
  Synthetic oligonucleotide
agtcacgcaatggcaa

SEQ ID NO: 872 - DNA, 16 bp, Artificial sequence
  Synthetic oligonucleotide
gaggaatgagcactct

SEQ ID NO: 873 - DNA, 16 bp, Artificial sequence
  Synthetic oligonucleotide
ggttacgcttattttt

SEQ ID NO: 874 - DNA, 16 bp, Artificial sequence
  Synthetic oligonucleotide
gctagatagcattctt

SEQ ID NO: 875 - DNA, 16 bp, Artificial sequence
  Synthetic oligonucleotide
tgccacagttgaaccc

SEQ ID NO: 876 - DNA, 16 bp, Artificial sequence
  Synthetic oligonucleotide
tagcatcagagctaga

SEQ ID NO: 877 - DNA, 16 bp, Artificial sequence
  Synthetic oligonucleotide
ctggattgatgtgata

SEQ ID NO: 878 - DNA, 16 bp, Artificial sequence
  Synthetic oligonucleotide
actactattgtggaaa

SEQ ID NO: 879 - DNA, 16 bp, Artificial sequence
  Synthetic oligonucleotide
gtgacttaattctggg

SEQ ID NO: 880 - DNA, 16 bp, Artificial sequence
  Synthetic oligonucleotide
gtgaaactgagagtgc

SEQ ID NO: 881 - DNA, 16 bp, Artificial sequence
  Synthetic oligonucleotide
taaacagtgcccaagc

SEQ ID NO: 882 - DNA, 16 bp, Artificial sequence
  Synthetic oligonucleotide
ggatttccgggtgtgg

SEQ ID NO: 883 - DNA, 16 bp, Artificial sequence
  Synthetic oligonucleotide
caagaactgctgtgtg

SEQ ID NO: 884 - DNA, 16 bp, Artificial sequence
  Synthetic oligonucleotide
ggtaatcttctggatt

SEQ ID NO: 885 - DNA, 16 bp, Artificial sequence
  Synthetic oligonucleotide
acagtaagagggcagt

SEQ ID NO: 886 - DNA, 16 bp, Artificial sequence
  Synthetic oligonucleotide
acacatcacttggtca

SEQ ID NO: 887 - DNA, 16 bp, Artificial sequence
  Synthetic oligonucleotide
acctacaagcagtcat

SEQ ID NO: 888 - DNA, 16 bp, Artificial sequence
  Synthetic oligonucleotide
gctacaggcacggctt

SEQ ID NO: 889 - DNA, 16 bp, Artificial sequence
  Synthetic oligonucleotide
attactagattgtagg

SEQ ID NO: 890 - DNA, 16 bp, Artificial sequence
  Synthetic oligonucleotide
gggcaacagttcaagt

SEQ ID NO: 891 - DNA, 16 bp, Artificial sequence
  Synthetic oligonucleotide
ccgtagtcagctccat

SEQ ID NO: 892 - DNA, 16 bp, Artificial sequence
  Synthetic oligonucleotide
agcaagtggaggtctt

SEQ ID NO: 893 - DNA, 16 bp, Artificial sequence
  Synthetic oligonucleotide
tatgagaaacggcctg

SEQ ID NO: 894 - DNA, 16 bp, Artificial sequence
  Synthetic oligonucleotide
taatgtagggatacag

SEQ ID NO: 895 - DNA, 16 bp, Artificial sequence
  Synthetic oligonucleotide
agaataaacacccctt

SEQ ID NO: 896 - DNA, 16 bp, Artificial sequence
  Synthetic oligonucleotide
ggcagtggagctccac

SEQ ID NO: 897 - DNA, 16 bp, Artificial sequence
  Synthetic oligonucleotide
gcagttcacgaaacac

SEQ ID NO: 898 - DNA, 16 bp, Artificial sequence
  Synthetic oligonucleotide
cagcaaagagggtcac

SEQ ID NO: 899 - DNA, 16 bp, Artificial sequence
  Synthetic oligonucleotide
tccctaggtcataccc

SEQ ID NO: 900 - DNA, 16 bp, Artificial sequence
  Synthetic oligonucleotide
tcaaatcttcaacagc

SEQ ID NO: 901 - DNA, 16 bp, Artificial sequence
  Synthetic oligonucleotide
gtctagctgggttttc

SEQ ID NO: 902 - DNA, 16 bp, Artificial sequence
  Synthetic oligonucleotide
actaatacctacctgc

SEQ ID NO: 903 - DNA, 16 bp, Artificial sequence
  Synthetic oligonucleotide
acgcacacacaagtgg

SEQ ID NO: 904 - DNA, 16 bp, Artificial sequence
  Synthetic oligonucleotide
ctggagagcaatgaac

SEQ ID NO: 905 - DNA, 16 bp, Artificial sequence
  Synthetic oligonucleotide
taacaggctatcagga

SEQ ID NO: 906 - DNA, 16 bp, Artificial sequence
  Synthetic oligonucleotide
gggaagtggaccccat

SEQ ID NO: 907 - DNA, 16 bp, Artificial sequence
  Synthetic oligonucleotide
cgacagcatagcatta

SEQ ID NO: 908 - DNA, 16 bp, Artificial sequence
  Synthetic oligonucleotide
atatgacgacttaagc

SEQ ID NO: 909 - DNA, 16 bp, Artificial sequence
  Synthetic oligonucleotide
gaatttacagcatcta

SEQ ID NO: 910 - DNA, 16 bp, Artificial sequence
  Synthetic oligonucleotide
gtccggttagctcatc

SEQ ID NO: 911 - DNA, 16 bp, Artificial sequence
  Synthetic oligonucleotide
gggagagcggaggcgg

SEQ ID NO: 912 - DNA, 16 bp, Artificial sequence
  Synthetic oligonucleotide
tcccaacccgcttctc

SEQ ID NO: 913 - DNA, 16 bp, Artificial sequence
  Synthetic oligonucleotide
cacgaggcaccgcact

SEQ ID NO: 914 - DNA, 16 bp, Artificial sequence
  Synthetic oligonucleotide
gaacgcacggacgaac

SEQ ID NO: 915 - DNA, 16 bp, Artificial sequence
  Synthetic oligonucleotide
gacgaaaacagccgcc

SEQ ID NO: 916 - DNA, 16 bp, Artificial sequence
  Synthetic oligonucleotide
tctgagagcaaattga

SEQ ID NO: 917 - DNA, 16 bp, Artificial sequence
  Synthetic oligonucleotide
acccacataactcagg

SEQ ID NO: 918 - DNA, 16 bp, Artificial sequence
  Synthetic oligonucleotide
gcatagtgatgagata

SEQ ID NO: 919 - DNA, 16 bp, Artificial sequence
  Synthetic oligonucleotide
gttgacaaataaggta

SEQ ID NO: 920 - DNA, 16 bp, Artificial sequence
  Synthetic oligonucleotide
ccaacaggcggacacg

SEQ ID NO: 921 - DNA, 16 bp, Artificial sequence
  Synthetic oligonucleotide
aggacaatggagatac

SEQ ID NO: 922 - DNA, 16 bp, Artificial sequence
  Synthetic oligonucleotide
agtgcaggagaggctg

SEQ ID NO: 923 - DNA, 16 bp, Artificial sequence
  Synthetic oligonucleotide
agaaaacccccctctc

SEQ ID NO: 924 - DNA, 16 bp, Artificial sequence
  Synthetic oligonucleotide
caccactattcgagag

SEQ ID NO: 925 - DNA, 16 bp, Artificial sequence
  Synthetic oligonucleotide
gataacctgaacatga

SEQ ID NO: 926 - DNA, 16 bp, Artificial sequence
  Synthetic oligonucleotide
acgcaagtctgaattt

SEQ ID NO: 927 - DNA, 16 bp, Artificial sequence
  Synthetic oligonucleotide
gacaatgttgtatgaa

SEQ ID NO: 928 - DNA, 16 bp, Artificial sequence
  Synthetic oligonucleotide
gaccaactggaaaacc

SEQ ID NO: 929 - DNA, 16 bp, Artificial sequence
  Synthetic oligonucleotide
cctaaatcaccctggt

SEQ ID NO: 930 - DNA, 16 bp, Artificial sequence
  Synthetic oligonucleotide
cagaactaatgtcccc

SEQ ID NO: 931 - DNA, 16 bp, Artificial sequence
  Synthetic oligonucleotide
gatgagaattccaaac

SEQ ID NO: 932 - DNA, 16 bp, Artificial sequence
  Synthetic oligonucleotide
acccacacaagtctta

SEQ ID NO: 933 - DNA, 16 bp, Artificial sequence
  Synthetic oligonucleotide
tcaacagcaggttttg

SEQ ID NO: 934 - DNA, 16 bp, Artificial sequence
  Synthetic oligonucleotide
gttcatgtaaagtctg

SEQ ID NO: 935 - DNA, 16 bp, Artificial sequence
  Synthetic oligonucleotide
aaaatataacggtgtt

SEQ ID NO: 936 - DNA, 16 bp, Artificial sequence
  Synthetic oligonucleotide
ggagaagtcccgtgga

SEQ ID NO: 937 - DNA, 16 bp, Artificial sequence
  Synthetic oligonucleotide
cgccgaagtcaacagg

SEQ ID NO: 938 - DNA, 16 bp, Artificial sequence
  Synthetic oligonucleotide
catgagggtgacacac

SEQ ID NO: 939 - DNA, 16 bp, Artificial sequence
  Synthetic oligonucleotide
cagcatgacagggcga

SEQ ID NO: 940 - DNA, 16 bp, Artificial sequence
  Synthetic oligonucleotide
gacatatttgctttgg

SEQ ID NO: 941 - DNA, 16 bp, Artificial sequence
  Synthetic oligonucleotide
agcttagtcaccacgg

SEQ ID NO: 942 - DNA, 16 bp, Artificial sequence
  Synthetic oligonucleotide
ctagataacatgagag

SEQ ID NO: 943 - DNA, 16 bp, Artificial sequence
  Synthetic oligonucleotide
ccaaatgacttagtca

SEQ ID NO: 944 - DNA, 16 bp, Artificial sequence
  Synthetic oligonucleotide
caataaaatgtcacgc

SEQ ID NO: 945 - DNA, 16 bp, Artificial sequence
  Synthetic oligonucleotide
agggatggaacagtaa

SEQ ID NO: 946 - DNA, 16 bp, Artificial sequence
  Synthetic oligonucleotide
cgggagataaagaaca

SEQ ID NO: 947 - DNA, 16 bp, Artificial sequence
  Synthetic oligonucleotide
tgcaagaggaatgagc

SEQ ID NO: 948 - DNA, 16 bp, Artificial sequence
  Synthetic oligonucleotide
gggttacgcttatttt

SEQ ID NO: 949 - DNA, 16 bp, Artificial sequence
  Synthetic oligonucleotide
aatgaagatccactag

SEQ ID NO: 950 - DNA, 16 bp, Artificial sequence
  Synthetic oligonucleotide
ttttagtgttacttgc

SEQ ID NO: 951 - DNA, 16 bp, Artificial sequence
  Synthetic oligonucleotide
aaatagcatcagagct

SEQ ID NO: 952 - DNA, 16 bp, Artificial sequence
  Synthetic oligonucleotide
aactggattgatgtga

SEQ ID NO: 953 - DNA, 16 bp, Artificial sequence
  Synthetic oligonucleotide
aaaactactattgtgg

SEQ ID NO: 954 - DNA, 16 bp, Artificial sequence
  Synthetic oligonucleotide
gccaaagtgacttaat

SEQ ID NO: 955 - DNA, 16 bp, Artificial sequence
  Synthetic oligonucleotide
aagaatggcgcatagg

SEQ ID NO: 956 - DNA, 16 bp, Artificial sequence
  Synthetic oligonucleotide
ggtgaaactgagagtg

SEQ ID NO: 957 - DNA, 16 bp, Artificial sequence
  Synthetic oligonucleotide
ttaaacagtgcccaag

SEQ ID NO: 958 - DNA, 16 bp, Artificial sequence
  Synthetic oligonucleotide
tggtacgggatttccg

SEQ ID NO: 959 - DNA, 16 bp, Artificial sequence
  Synthetic oligonucleotide
acaagaactgctgtgt

SEQ ID NO: 960 - DNA, 16 bp, Artificial sequence
  Synthetic oligonucleotide
tggtaatcttctggat

SEQ ID NO: 961 - DNA, 16 bp, Artificial sequence
  Synthetic oligonucleotide
aaaacagtaagagggc

SEQ ID NO: 962 - DNA, 16 bp, Artificial sequence
  Synthetic oligonucleotide
gtaaacacatcacttg

SEQ ID NO: 963 - DNA, 16 bp, Artificial sequence
  Synthetic oligonucleotide
tacctacaagcagtca

SEQ ID NO: 964 - DNA, 16 bp, Artificial sequence
  Synthetic oligonucleotide
ggctacaggcacggct

SEQ ID NO: 965 - DNA, 16 bp, Artificial sequence
  Synthetic oligonucleotide
cattactagattgtag

SEQ ID NO: 966 - DNA, 16 bp, Artificial sequence
  Synthetic oligonucleotide
cagaagggcaacagtt

SEQ ID NO: 967 - DNA, 16 bp, Artificial sequence
  Synthetic oligonucleotide
actgagtgtgcagttc

SEQ ID NO: 968 - DNA, 16 bp, Artificial sequence
  Synthetic oligonucleotide
aagcaagtggaggtct

SEQ ID NO: 969 - DNA, 16 bp, Artificial sequence
  Synthetic oligonucleotide
gtatgagaaacggcct

SEQ ID NO: 970 - DNA, 16 bp, Artificial sequence
  Synthetic oligonucleotide
gtaatgtagggataca

SEQ ID NO: 971 - DNA, 16 bp, Artificial sequence
  Synthetic oligonucleotide
gaagaataaacacccc

SEQ ID NO: 972 - DNA, 16 bp, Artificial sequence
  Synthetic oligonucleotide
tggcagtggagctcca

SEQ ID NO: 973 - DNA, 16 bp, Artificial sequence
  Synthetic oligonucleotide
catcactgcagttcac

SEQ ID NO: 974 - DNA, 16 bp, Artificial sequence
  Synthetic oligonucleotide
cttcagcaaagagggt

SEQ ID NO: 975 - DNA, 16 bp, Artificial sequence
  Synthetic oligonucleotide
catagctagttcattc

SEQ ID NO: 976 - DNA, 16 bp, Artificial sequence
  Synthetic oligonucleotide
tccatatgacccagtg

SEQ ID NO: 977 - DNA, 16 bp, Artificial sequence
  Synthetic oligonucleotide
caatagtctagctggg

SEQ ID NO: 978 - DNA, 16 bp, Artificial sequence
  Synthetic oligonucleotide
caaacactaataccta

SEQ ID NO: 979 - DNA, 16 bp, Artificial sequence
  Synthetic oligonucleotide
gtaactgacacgcaca

SEQ ID NO: 980 - DNA, 16 bp, Artificial sequence
  Synthetic oligonucleotide
gggcatgtgactggag

SEQ ID NO: 981 - DNA, 16 bp, Artificial sequence
  Synthetic oligonucleotide
gtaacaggctatcagg

SEQ ID NO: 982 - DNA, 16 bp, Artificial sequence
  Synthetic oligonucleotide
gcaaaacgcagagcca

SEQ ID NO: 983 - DNA, 16 bp, Artificial sequence
  Synthetic oligonucleotide
acgacagcatagcatt

SEQ ID NO: 984 - DNA, 16 bp, Artificial sequence
  Synthetic oligonucleotide
tatatgacgacttaag

SEQ ID NO: 985 - DNA, 16 bp, Artificial sequence
  Synthetic oligonucleotide
tcctgaatttacagca

SEQ ID NO: 986 - DNA, 16 bp, Artificial sequence
  Synthetic oligonucleotide
cgggagagcggaggcg

SEQ ID NO: 987 - DNA, 16 bp, Artificial sequence
  Synthetic oligonucleotide
ccgcactcactcgcag

SEQ ID NO: 988 - DNA, 16 bp, Artificial sequence
  Synthetic oligonucleotide
ccacgaggcaccgcac

SEQ ID NO: 989 - DNA, 16 bp, Artificial sequence
  Synthetic oligonucleotide
acgagaacgcacggac

SEQ ID NO: 990 - DNA, 16 bp, Artificial sequence
  Synthetic oligonucleotide
agacgaaaacagccgc

SEQ ID NO: 991 - DNA, 16 bp, Artificial sequence
  Synthetic oligonucleotide
actaaggacagctgtg

SEQ ID NO: 992 - DNA, 16 bp, Artificial sequence
  Synthetic oligonucleotide
gaaagaatggcgcata

SEQ ID NO: 993 - DNA, 16 bp, Artificial sequence
  Synthetic oligonucleotide
ttcaacttgtgaccca

SEQ ID NO: 994 - DNA, 16 bp, Artificial sequence
  Synthetic oligonucleotide
tgcatagtgatgagat

SEQ ID NO: 995 - DNA, 16 bp, Artificial sequence
  Synthetic oligonucleotide
taacacggtgttgaca

SEQ ID NO: 996 - DNA, 16 bp, Artificial sequence
  Synthetic oligonucleotide
tccaacaggcggacac

SEQ ID NO: 997 - DNA, 16 bp, Artificial sequence
  Synthetic oligonucleotide
gatcataaaggacaat

SEQ ID NO: 998 - DNA, 16 bp, Artificial sequence
  Synthetic oligonucleotide
aaggagtgcaggagag

SEQ ID NO: 999 - DNA, 16 bp, Artificial sequence
  Synthetic oligonucleotide
gagaaaacccccctct

SEQ ID NO: 1000 - DNA, 16 bp, Artificial sequence
  Synthetic oligonucleotide
acacaccactattcga

SEQ ID NO: 1001 - DNA, 16 bp, Artificial sequence
  Synthetic oligonucleotide
caaggataacctgaac

SEQ ID NO: 1002 - DNA, 16 bp, Artificial sequence
  Synthetic oligonucleotide
gcagtaaacgcaagtc

SEQ ID NO: 1003 - DNA, 16 bp, Artificial sequence
  Synthetic oligonucleotide
ctgaagacaatgttgt

SEQ ID NO: 1004 - DNA, 16 bp, Artificial sequence
  Synthetic oligonucleotide
tagcagggcacgctct

SEQ ID NO: 1005 - DNA, 16 bp, Artificial sequence
  Synthetic oligonucleotide
tcctaaatcaccctgg

SEQ ID NO: 1006 - DNA, 16 bp, Artificial sequence
  Synthetic oligonucleotide
accagaactaatgtcc

SEQ ID NO: 1007 - DNA, 16 bp, Artificial sequence
  Synthetic oligonucleotide
ggcaagatgagaattc

SEQ ID NO: 1008 - DNA, 16 bp, Artificial sequence
  Synthetic oligonucleotide
gagatataaatagctg

SEQ ID NO: 1009 - DNA, 16 bp, Artificial sequence
  Synthetic oligonucleotide
aactatcttattcctc

SEQ ID NO: 1010 - DNA, 16 bp, Artificial sequence
  Synthetic oligonucleotide
aaaaatataacggtgt

SEQ ID NO: 1011 - DNA, 16 bp, Artificial sequence
  Synthetic oligonucleotide
aacacttggagaagtc

SEQ ID NO: 1012 - DNA, 16 bp, Artificial sequence
  Synthetic oligonucleotide
agtcaagccccaagcc

SEQ ID NO: 1013 - DNA, 16 bp, Artificial sequence
  Synthetic oligonucleotide
gcatgagggtgacaca

SEQ ID NO: 1014 - DNA, 16 bp, Artificial sequence
  Synthetic oligonucleotide
tcccacgcgggaggct

SEQ ID NO: 1015 - DNA, 16 bp, Artificial sequence
  Synthetic oligonucleotide
ggacatatttgctttg

SEQ ID NO: 1016 - DNA, 16 bp, Artificial sequence
  Synthetic oligonucleotide
ttccagcttagtcacc

SEQ ID NO: 1017 - DNA, 16 bp, Artificial sequence
  Synthetic oligonucleotide
cctagataacatgaga

SEQ ID NO: 1018 - DNA, 16 bp, Artificial sequence
  Synthetic oligonucleotide
cccaaatgacttagtc

SEQ ID NO: 1019 - DNA, 16 bp, Artificial sequence
  Synthetic oligonucleotide
acaataaaatgtcacg

SEQ ID NO: 1020 - DNA, 16 bp, Artificial sequence
  Synthetic oligonucleotide
ctccagggatggaaca

SEQ ID NO: 1021 - DNA, 16 bp, Artificial sequence
  Synthetic oligonucleotide
gaccacagtgaagtcg

SEQ ID NO: 1022 - DNA, 16 bp, Artificial sequence
  Synthetic oligonucleotide
gcttactgtgattctg

SEQ ID NO: 1023 - DNA, 16 bp, Artificial sequence
  Synthetic oligonucleotide
aagggttacgcttatt

SEQ ID NO: 1024 - DNA, 16 bp, Artificial sequence
  Synthetic oligonucleotide
atggatagtttctcat

SEQ ID NO: 1025 - DNA, 16 bp, Artificial sequence
  Synthetic oligonucleotide
tcctaaccctaccctt

SEQ ID NO: 1026 - DNA, 16 bp, Artificial sequence
  Synthetic oligonucleotide
gaaatagcatcagagc

SEQ ID NO: 1027 - DNA, 16 bp, Artificial sequence
  Synthetic oligonucleotide
atccatgtcaacttta

SEQ ID NO: 1028 - DNA, 16 bp, Artificial sequence
  Synthetic oligonucleotide
caaaactactattgtg

SEQ ID NO: 1029 - DNA, 16 bp, Artificial sequence
  Synthetic oligonucleotide
agccaaagtgacttaa

SEQ ID NO: 1030 - DNA, 16 bp, Artificial sequence
  Synthetic oligonucleotide
cgacagtccggttagc

SEQ ID NO: 1031 - DNA, 16 bp, Artificial sequence
  Synthetic oligonucleotide
ttccacactggatatg

SEQ ID NO: 1032 - DNA, 16 bp, Artificial sequence
  Synthetic oligonucleotide
atcgagcggtgaaact

SEQ ID NO: 1033 - DNA, 16 bp, Artificial sequence
  Synthetic oligonucleotide
tcggaactttccttta

SEQ ID NO: 1034 - DNA, 16 bp, Artificial sequence
  Synthetic oligonucleotide
cattggtacgggattt

SEQ ID NO: 1035 - DNA, 16 bp, Artificial sequence
  Synthetic oligonucleotide
gacaagaactgctgtg

SEQ ID NO: 1036 - DNA, 16 bp, Artificial sequence
  Synthetic oligonucleotide
ggatagatctgtggta

SEQ ID NO: 1037 - DNA, 16 bp, Artificial sequence
  Synthetic oligonucleotide
caaaacagtaagaggg

SEQ ID NO: 1038 - DNA, 16 bp, Artificial sequence
  Synthetic oligonucleotide
gcgcatttcagtaaat

SEQ ID NO: 1039 - DNA, 16 bp, Artificial sequence
  Synthetic oligonucleotide
catacctacaagcagt

SEQ ID NO: 1040 - DNA, 16 bp, Artificial sequence
  Synthetic oligonucleotide
caaggctacaggcacg

SEQ ID NO: 1041 - DNA, 16 bp, Artificial sequence
  Synthetic oligonucleotide
acattactagattgta

SEQ ID NO: 1042 - DNA, 16 bp, Artificial sequence
  Synthetic oligonucleotide
ttggacagaagggcaa

SEQ ID NO: 1043 - DNA, 16 bp, Artificial sequence
  Synthetic oligonucleotide
aaacagcccactgagt

SEQ ID NO: 1044 - DNA, 16 bp, Artificial sequence
  Synthetic oligonucleotide
taagcaagtggaggtc

SEQ ID NO: 1045 - DNA, 16 bp, Artificial sequence
  Synthetic oligonucleotide
agtatgagaaacggcc

SEQ ID NO: 1046 - DNA, 16 bp, Artificial sequence
  Synthetic oligonucleotide
tgtaatgtagggatac

SEQ ID NO: 1047 - DNA, 16 bp, Artificial sequence
  Synthetic oligonucleotide
gcaagatgactccatg

SEQ ID NO: 1048 - DNA, 16 bp, Artificial sequence
  Synthetic oligonucleotide
atggcagtggagctcc

SEQ ID NO: 1049 - DNA, 16 bp, Artificial sequence
  Synthetic oligonucleotide
atacatcactgcagtt

SEQ ID NO: 1050 - DNA, 16 bp, Artificial sequence
  Synthetic oligonucleotide
gggttaaatattcttc

SEQ ID NO: 1051 - DNA, 16 bp, Artificial sequence
  Synthetic oligonucleotide
tcatagctagttcatt

SEQ ID NO: 1052 - DNA, 16 bp, Artificial sequence
  Synthetic oligonucleotide
aaccaagaaatgcacc

SEQ ID NO: 1053 - DNA, 16 bp, Artificial sequence
  Synthetic oligonucleotide
ccaatagtctagctgg

SEQ ID NO: 1054 - DNA, 16 bp, Artificial sequence
  Synthetic oligonucleotide
tcaaacactaatacct

SEQ ID NO: 1055 - DNA, 16 bp, Artificial sequence
  Synthetic oligonucleotide
agtaactgacacgcac

SEQ ID NO: 1056 - DNA, 16 bp, Artificial sequence
  Synthetic oligonucleotide
ttaaccaatcccaaca

SEQ ID NO: 1057 - DNA, 16 bp, Artificial sequence
  Synthetic oligonucleotide
tgtaacaggctatcag

SEQ ID NO: 1058 - DNA, 16 bp, Artificial sequence
  Synthetic oligonucleotide
agcaaaacgcagagcc

SEQ ID NO: 1059 - DNA, 16 bp, Artificial sequence
  Synthetic oligonucleotide
aacgacagcatagcat

SEQ ID NO: 1060 - DNA, 16 bp, Artificial sequence
  Synthetic oligonucleotide
atatatgacgacttaa

SEQ ID NO: 1061 - DNA, 16 bp, Artificial sequence
  Synthetic oligonucleotide
gccttaatgttcagct

SEQ ID NO: 1062 - DNA, 16 bp, Artificial sequence
  Synthetic oligonucleotide
gccttggacggccccg

SEQ ID NO: 1063 - DNA, 16 bp, Artificial sequence
  Synthetic oligonucleotide
ccggagcaggcccggg

SEQ ID NO: 1064 - DNA, 16 bp, Artificial sequence
  Synthetic oligonucleotide
ccgacacgcgccgctc

SEQ ID NO: 1065 - DNA, 16 bp, Artificial sequence
  Synthetic oligonucleotide
agccacgaggcaccgc

SEQ ID NO: 1066 - DNA, 16 bp, Artificial sequence
  Synthetic oligonucleotide
ggaaacgagaacgcac

SEQ ID NO: 1067 - DNA, 16 bp, Artificial sequence
  Synthetic oligonucleotide
tgagagacgaaaacag

SEQ ID NO: 1068 - DNA, 16 bp, Artificial sequence
  Synthetic oligonucleotide
gcctaggactaaggac

SEQ ID NO: 1069 - DNA, 16 bp, Artificial sequence
  Synthetic oligonucleotide
aagaaagaatggcgca

SEQ ID NO: 1070 - DNA, 16 bp, Artificial sequence
  Synthetic oligonucleotide
tgctgaaccccacagg

SEQ ID NO: 1071 - DNA, 16 bp, Artificial sequence
  Synthetic oligonucleotide
atgcatagtgatgaga

SEQ ID NO: 1072 - DNA, 16 bp, Artificial sequence
  Synthetic oligonucleotide
cataacacggtgttga

SEQ ID NO: 1073 - DNA, 16 bp, Artificial sequence
  Synthetic oligonucleotide
ttccaacaggcggaca

SEQ ID NO: 1074 - DNA, 16 bp, Artificial sequence
  Synthetic oligonucleotide
catggaggatcataaa

SEQ ID NO: 1075 - DNA, 16 bp, Artificial sequence
  Synthetic oligonucleotide
aggaagcactggcatc

SEQ ID NO: 1076 - DNA, 16 bp, Artificial sequence
  Synthetic oligonucleotide
taaacttggctgtggg

SEQ ID NO: 1077 - DNA, 16 bp, Artificial sequence
  Synthetic oligonucleotide
ttccaacaatagcaac

SEQ ID NO: 1078 - DNA, 16 bp, Artificial sequence
  Synthetic oligonucleotide
gagcagtaaacgcaag

SEQ ID NO: 1079 - DNA, 16 bp, Artificial sequence
  Synthetic oligonucleotide
aaccatgttcctgaag

SEQ ID NO: 1080 - DNA, 16 bp, Artificial sequence
  Synthetic oligonucleotide
actagcagggcacgct

SEQ ID NO: 1081 - DNA, 16 bp, Artificial sequence
  Synthetic oligonucleotide
tctaatggtgctccta

SEQ ID NO: 1082 - DNA, 16 bp, Artificial sequence
  Synthetic oligonucleotide
gatgagggaccagaac

SEQ ID NO: 1083 - DNA, 16 bp, Artificial sequence
  Synthetic oligonucleotide
gggcaagatgagaatt

SEQ ID NO: 1084 - DNA, 16 bp, Artificial sequence
  Synthetic oligonucleotide
ccgagatataaatagc

SEQ ID NO: 1085 - DNA, 16 bp, Artificial sequence
  Synthetic oligonucleotide
tatcatgcataccaaa

SEQ ID NO: 1086 - DNA, 16 bp, Artificial sequence
  Synthetic oligonucleotide
tggtagaatgtgatat

SEQ ID NO: 1087 - DNA, 16 bp, Artificial sequence
  Synthetic oligonucleotide
gcaaaaaatataacgg

SEQ ID NO: 1088 - DNA, 16 bp, Artificial sequence
  Synthetic oligonucleotide
cgtcaaggaggcctgg

SEQ ID NO: 1089 - DNA, 16 bp, Artificial sequence
  Synthetic oligonucleotide
ctctactggagtcaag

SEQ ID NO: 1090 - DNA, 16 bp, Artificial sequence
  Synthetic oligonucleotide
tgcatgagggtgacac

SEQ ID NO: 1091 - DNA, 16 bp, Artificial sequence
  Synthetic oligonucleotide
ggcgagtggcgggtag

SEQ ID NO: 1092 - DNA, 16 bp, Artificial sequence
  Synthetic oligonucleotide
ctgaagcttagttatc

SEQ ID NO: 1093 - DNA, 16 bp, Artificial sequence
  Synthetic oligonucleotide
actcaatgtgcacctt

SEQ ID NO: 1094 - DNA, 16 bp, Artificial sequence
  Synthetic oligonucleotide
ccctagataacatgag

SEQ ID NO: 1095 - DNA, 16 bp, Artificial sequence
  Synthetic oligonucleotide
acttacaggactattt

SEQ ID NO: 1096 - DNA, 16 bp, Artificial sequence
  Synthetic oligonucleotide
gacaaatcttctgcct

SEQ ID NO: 1097 - DNA, 16 bp, Artificial sequence
  Synthetic oligonucleotide
tgtaactctgagtaga

SEQ ID NO: 1098 - DNA, 16 bp, Artificial sequence
  Synthetic oligonucleotide
gtagaccacagtgaag

SEQ ID NO: 1099 - DNA, 16 bp, Artificial sequence
  Synthetic oligonucleotide
aagcaagagcttactg

SEQ ID NO: 1100 - DNA, 16 bp, Artificial sequence
  Synthetic oligonucleotide
agtttaagggttacgc

SEQ ID NO: 1101 - DNA, 16 bp, Artificial sequence
  Synthetic oligonucleotide
aatggatagtttctca

SEQ ID NO: 1102 - DNA, 16 bp, Artificial sequence
  Synthetic oligonucleotide
tctaaccctaatccta

SEQ ID NO: 1103 - DNA, 16 bp, Artificial sequence
  Synthetic oligonucleotide
gttcaagattaaacca

SEQ ID NO: 1104 - DNA, 16 bp, Artificial sequence
  Synthetic oligonucleotide
ttgcatccatgtcaac

SEQ ID NO: 1105 - DNA, 16 bp, Artificial sequence
  Synthetic oligonucleotide
gtatagttctcaacca

SEQ ID NO: 1106 - DNA, 16 bp, Artificial sequence
  Synthetic oligonucleotide
tccatagatcaacatg

SEQ ID NO: 1107 - DNA, 16 bp, Artificial sequence
  Synthetic oligonucleotide
ccaaggataacctgaa

SEQ ID NO: 1108 - DNA, 16 bp, Artificial sequence
  Synthetic oligonucleotide
gatcgagcggtgaaac

SEQ ID NO: 1109 - DNA, 16 bp, Artificial sequence
  Synthetic oligonucleotide
aagcgcaccgcaggcg

SEQ ID NO: 1110 - DNA, 16 bp, Artificial sequence
  Synthetic oligonucleotide
gacattggtacgggat

SEQ ID NO: 1111 - DNA, 16 bp, Artificial sequence
  Synthetic oligonucleotide
tgacaagaactgctgt

SEQ ID NO: 1112 - DNA, 16 bp, Artificial sequence
  Synthetic oligonucleotide
gcggatagatctgtgg

SEQ ID NO: 1113 - DNA, 16 bp, Artificial sequence
  Synthetic oligonucleotide
cgctgaactgaaatct

SEQ ID NO: 1114 - DNA, 16 bp, Artificial sequence
  Synthetic oligonucleotide
aaagagcgcatttcag

SEQ ID NO: 1115 - DNA, 16 bp, Artificial sequence
  Synthetic oligonucleotide
acatacctacaagcag

SEQ ID NO: 1116 - DNA, 16 bp, Artificial sequence
  Synthetic oligonucleotide
ccccaaggctacaggc

SEQ ID NO: 1117 - DNA, 16 bp, Artificial sequence
  Synthetic oligonucleotide
agacattactagattg

SEQ ID NO: 1118 - DNA, 16 bp, Artificial sequence
  Synthetic oligonucleotide
agtacttggacagaag

SEQ ID NO: 1119 - DNA, 16 bp, Artificial sequence
  Synthetic oligonucleotide
gaggaagcatagaaca

SEQ ID NO: 1120 - DNA, 16 bp, Artificial sequence
  Synthetic oligonucleotide
cttaagcaagtggagg

SEQ ID NO: 1121 - DNA, 16 bp, Artificial sequence
  Synthetic oligonucleotide
tagtatgagaaacggc

SEQ ID NO: 1122 - DNA, 16 bp, Artificial sequence
  Synthetic oligonucleotide
gtgtaatgtagggata

SEQ ID NO: 1123 - DNA, 16 bp, Artificial sequence
  Synthetic oligonucleotide
tgcaagatgactccat

SEQ ID NO: 1124 - DNA, 16 bp, Artificial sequence
  Synthetic oligonucleotide
acatggcagtggagct

SEQ ID NO: 1125 - DNA, 16 bp, Artificial sequence
  Synthetic oligonucleotide
gtatacatcactgcag

SEQ ID NO: 1126 - DNA, 16 bp, Artificial sequence
  Synthetic oligonucleotide
ctttgaagtgctgtgt

SEQ ID NO: 1127 - DNA, 16 bp, Artificial sequence
  Synthetic oligonucleotide
ttcatagctagttcat

SEQ ID NO: 1128 - DNA, 16 bp, Artificial sequence
  Synthetic oligonucleotide
ttgaggttttcctaaa

SEQ ID NO: 1129 - DNA, 16 bp, Artificial sequence
  Synthetic oligonucleotide
cccaatagtctagctg

SEQ ID NO: 1130 - DNA, 16 bp, Artificial sequence
  Synthetic oligonucleotide
gaccagctttttcaaa

SEQ ID NO: 1131 - DNA, 16 bp, Artificial sequence
  Synthetic oligonucleotide
aagtaactgacacgca

SEQ ID NO: 1132 - DNA, 16 bp, Artificial sequence
  Synthetic oligonucleotide
accttaaccaatccca

SEQ ID NO: 1133 - DNA, 16 bp, Artificial sequence
  Synthetic oligonucleotide
ctgtaacaggctatca

SEQ ID NO: 1134 - DNA, 16 bp, Artificial sequence
  Synthetic oligonucleotide
cagcaaaacgcagagc

SEQ ID NO: 1135 - DNA, 16 bp, Artificial sequence
  Synthetic oligonucleotide
ccaacgacagcatagc

SEQ ID NO: 1136 - DNA, 16 bp, Artificial sequence
  Synthetic oligonucleotide
tatatatgacgactta

SEQ ID NO: 1137 - DNA, 16 bp, Artificial sequence
  Synthetic oligonucleotide
cgccttaatgttcagc

SEQ ID NO: 1138 - DNA, 16 bp, Artificial sequence
  Synthetic oligonucleotide
aggcagttgtgccgtc

SEQ ID NO: 1139 - DNA, 16 bp, Artificial sequence
  Synthetic oligonucleotide
ccggaccccggagcag

SEQ ID NO: 1140 - DNA, 16 bp, Artificial sequence
  Synthetic oligonucleotide
cccgacacgcgccgct

SEQ ID NO: 1141 - DNA, 16 bp, Artificial sequence
  Synthetic oligonucleotide
ttcagccacgaggcac

SEQ ID NO: 1142 - DNA, 16 bp, Artificial sequence
  Synthetic oligonucleotide
gtggaaacgagaacgc

SEQ ID NO: 1143 - DNA, 16 bp, Artificial sequence
  Synthetic oligonucleotide
cagagacgcggtgaga

SEQ ID NO: 1144 - DNA, 16 bp, Artificial sequence
  Synthetic oligonucleotide
tgcctaggactaagga

SEQ ID NO: 1145 - DNA, 16 bp, Artificial sequence
  Synthetic oligonucleotide
gctaaacccaaaatac

SEQ ID NO: 1146 - DNA, 16 bp, Artificial sequence
  Synthetic oligonucleotide
tcctatgctgaacccc

SEQ ID NO: 1147 - DNA, 16 bp, Artificial sequence
  Synthetic oligonucleotide
taccatgcatagtgat

SEQ ID NO: 1148 - DNA, 16 bp, Artificial sequence
  Synthetic oligonucleotide
tgcataacacggtgtt

SEQ ID NO: 1149 - DNA, 16 bp, Artificial sequence
  Synthetic oligonucleotide
gcatattccaacaggc

SEQ ID NO: 1150 - DNA, 16 bp, Artificial sequence
  Synthetic oligonucleotide
actcatggaggatcat

SEQ ID NO: 1151 - DNA, 16 bp, Artificial sequence
  Synthetic oligonucleotide
taggaagcactggcat

SEQ ID NO: 1152 - DNA, 16 bp, Artificial sequence
  Synthetic oligonucleotide
gtaaacttggctgtgg

SEQ ID NO: 1153 - DNA, 16 bp, Artificial sequence
  Synthetic oligonucleotide
tggtatttttccgttc

SEQ ID NO: 1154 - DNA, 16 bp, Artificial sequence
  Synthetic oligonucleotide
gccaaggataacctga

SEQ ID NO: 1155 - DNA, 16 bp, Artificial sequence
  Synthetic oligonucleotide
agccagagcagtaaac

SEQ ID NO: 1156 - DNA, 16 bp, Artificial sequence
  Synthetic oligonucleotide
actgaaccatgttcct

SEQ ID NO: 1157 - DNA, 16 bp, Artificial sequence
  Synthetic oligonucleotide
caactagcagggcacg

SEQ ID NO: 1158 - DNA, 16 bp, Artificial sequence
  Synthetic oligonucleotide
ttctaatggtgctcct

SEQ ID NO: 1159 - DNA, 16 bp, Artificial sequence
  Synthetic oligonucleotide
gcacatcaatgtttta

SEQ ID NO: 1160 - DNA, 16 bp, Artificial sequence
  Synthetic oligonucleotide
aaagatgccagagggc

SEQ ID NO: 1161 - DNA, 16 bp, Artificial sequence
  Synthetic oligonucleotide
tgccgagatataaata

SEQ ID NO: 1162 - DNA, 16 bp, Artificial sequence
  Synthetic oligonucleotide
gtatcatgcataccaa

SEQ ID NO: 1163 - DNA, 16 bp, Artificial sequence
  Synthetic oligonucleotide
gccttaatggtgattt

SEQ ID NO: 1164 - DNA, 16 bp, Artificial sequence
  Synthetic oligonucleotide
acaaaaggttcccgcg

SEQ ID NO: 1165 - DNA, 16 bp, Artificial sequence
  Synthetic oligonucleotide
cagaagatctctactg

SEQ ID NO: 1166 - DNA, 16 bp, Artificial sequence
  Synthetic oligonucleotide
ctgcatgagggtgaca

SEQ ID NO: 1167 - DNA, 16 bp, Artificial sequence
  Synthetic oligonucleotide
gaagagttggcggtgg

SEQ ID NO: 1168 - DNA, 16 bp, Artificial sequence
  Synthetic oligonucleotide
cctgaagcttagttat

SEQ ID NO: 1169 - DNA, 16 bp, Artificial sequence
  Synthetic oligonucleotide
acgcagtgcacctgtg

SEQ ID NO: 1170 - DNA, 16 bp, Artificial sequence
  Synthetic oligonucleotide
ctccaaccctagataa

SEQ ID NO: 1171 - DNA, 16 bp, Artificial sequence
  Synthetic oligonucleotide
aacttacaggactatt

SEQ ID NO: 1172 - DNA, 16 bp, Artificial sequence
  Synthetic oligonucleotide
agacaaatcttctgcc

SEQ ID NO: 1173 - DNA, 16 bp, Artificial sequence
  Synthetic oligonucleotide
ctgaactgtgtaactc

SEQ ID NO: 1174 - DNA, 16 bp, Artificial sequence
  Synthetic oligonucleotide
tagtagaccacagtga

SEQ ID NO: 1175 - DNA, 16 bp, Artificial sequence
  Synthetic oligonucleotide
caccaggttaaacagg

SEQ ID NO: 1176 - DNA, 16 bp, Artificial sequence
  Synthetic oligonucleotide
tagtttaagggttacg

SEQ ID NO: 1177 - DNA, 16 bp, Artificial sequence
  Synthetic oligonucleotide
ctccagggaatggata

SEQ ID NO: 1178 - DNA, 16 bp, Artificial sequence
  Synthetic oligonucleotide
gaaaactctaacccta

SEQ ID NO: 1179 - DNA, 16 bp, Artificial sequence
  Synthetic oligonucleotide
ttatatactggttggt

SEQ ID NO: 1180 - DNA, 16 bp, Artificial sequence
  Synthetic oligonucleotide
ttagaggacagtgact

SEQ ID NO: 1181 - DNA, 16 bp, Artificial sequence
  Synthetic oligonucleotide
tgtatagttctcaacc

SEQ ID NO: 1182 - DNA, 16 bp, Artificial sequence
  Synthetic oligonucleotide
ttccatagatcaacat

SEQ ID NO: 1183 - DNA, 16 bp, Artificial sequence
  Synthetic oligonucleotide
ccctaagtttaattta

SEQ ID NO: 1184 - DNA, 16 bp, Artificial sequence
  Synthetic oligonucleotide
agatcgagcggtgaaa

SEQ ID NO: 1185 - DNA, 16 bp, Artificial sequence
  Synthetic oligonucleotide
tcaaagcgcaccgcag

SEQ ID NO: 1186 - DNA, 16 bp, Artificial sequence
  Synthetic oligonucleotide
tgggacattggtacgg

SEQ ID NO: 1187 - DNA, 16 bp, Artificial sequence
  Synthetic oligonucleotide
ctgacaagaactgctg

SEQ ID NO: 1188 - DNA, 16 bp, Artificial sequence
  Synthetic oligonucleotide
ggcggatagatctgtg

SEQ ID NO: 1189 - DNA, 16 bp, Artificial sequence
  Synthetic oligonucleotide
aaccgctgaactgaaa

SEQ ID NO: 1190 - DNA, 16 bp, Artificial sequence
  Synthetic oligonucleotide
ttaaagagcgcatttc

SEQ ID NO: 1191 - DNA, 16 bp, Artificial sequence
  Synthetic oligonucleotide
gacatacctacaagca

SEQ ID NO: 1192 - DNA, 16 bp, Artificial sequence
  Synthetic oligonucleotide
aaccgctggcaggtgg

SEQ ID NO: 1193 - DNA, 16 bp, Artificial sequence
  Synthetic oligonucleotide
ttagacattactagat

SEQ ID NO: 1194 - DNA, 16 bp, Artificial sequence
  Synthetic oligonucleotide
aagtacttggacagaa

SEQ ID NO: 1195 - DNA, 16 bp, Artificial sequence
  Synthetic oligonucleotide
cacgaggaagcataga

SEQ ID NO: 1196 - DNA, 16 bp, Artificial sequence
  Synthetic oligonucleotide
acttaagcaagtggag

SEQ ID NO: 1197 - DNA, 16 bp, Artificial sequence
  Synthetic oligonucleotide
tgtagtatgagaaacg

SEQ ID NO: 1198 - DNA, 16 bp, Artificial sequence
  Synthetic oligonucleotide
gctgaactgtgtaatg

SEQ ID NO: 1199 - DNA, 16 bp, Artificial sequence
  Synthetic oligonucleotide
gtgcaagatgactcca

SEQ ID NO: 1200 - DNA, 16 bp, Artificial sequence
  Synthetic oligonucleotide
gtacatggcagtggag

SEQ ID NO: 1201 - DNA, 16 bp, Artificial sequence
  Synthetic oligonucleotide
tgtatacatcactgca

SEQ ID NO: 1202 - DNA, 16 bp, Artificial sequence
  Synthetic oligonucleotide
agcttctttgaagtgc

SEQ ID NO: 1203 - DNA, 16 bp, Artificial sequence
  Synthetic oligonucleotide
tttcatagctagttca

SEQ ID NO: 1204 - DNA, 16 bp, Artificial sequence
  Synthetic oligonucleotide
gcttgaggttttccta

SEQ ID NO: 1205 - DNA, 16 bp, Artificial sequence
  Synthetic oligonucleotide
tcatacccaatagtct

SEQ ID NO: 1206 - DNA, 16 bp, Artificial sequence
  Synthetic oligonucleotide
cgctcaaagaccagct

SEQ ID NO: 1207 - DNA, 16 bp, Artificial sequence
  Synthetic oligonucleotide
aaagtaactgacacgc

SEQ ID NO: 1208 - DNA, 16 bp, Artificial sequence
  Synthetic oligonucleotide
gaccttaaccaatccc

SEQ ID NO: 1209 - DNA, 16 bp, Artificial sequence
  Synthetic oligonucleotide
gacctttacttcattc

SEQ ID NO: 1210 - DNA, 16 bp, Artificial sequence
  Synthetic oligonucleotide
tctcagcaaaacgcag

SEQ ID NO: 1211 - DNA, 16 bp, Artificial sequence
  Synthetic oligonucleotide
accaacgacagcatag

SEQ ID NO: 1212 - DNA, 16 bp, Artificial sequence
  Synthetic oligonucleotide
ttatatatgacgactt

SEQ ID NO: 1213 - DNA, 16 bp, Artificial sequence
  Synthetic oligonucleotide
tcgcaggcagttgtgc

SEQ ID NO: 1214 - DNA, 16 bp, Artificial sequence
  Synthetic oligonucleotide
cgccggaccccggagc

SEQ ID NO: 1215 - DNA, 16 bp, Artificial sequence
  Synthetic oligonucleotide
ccaaaggctcccgaca

SEQ ID NO: 1216 - DNA, 16 bp, Artificial sequence
  Synthetic oligonucleotide
cccttcagccacgagg

SEQ ID NO: 1217 - DNA, 16 bp, Artificial sequence
  Synthetic oligonucleotide
cgtggaaacgagaacg

SEQ ID NO: 1218 - DNA, 16 bp, Artificial sequence
  Synthetic oligonucleotide
tctgagtgagcttgcc

SEQ ID NO: 1219 - DNA, 16 bp, Artificial sequence
  Synthetic oligonucleotide
tgcataggcatccttc

SEQ ID NO: 1220 - DNA, 16 bp, Artificial sequence
  Synthetic oligonucleotide
attaattctcctatgc

SEQ ID NO: 1221 - DNA, 16 bp, Artificial sequence
  Synthetic oligonucleotide
tattaccatgcatagt

SEQ ID NO: 1222 - DNA, 16 bp, Artificial sequence
  Synthetic oligonucleotide
aatgcataacacggtg

SEQ ID NO: 1223 - DNA, 16 bp, Artificial sequence
  Synthetic oligonucleotide
agcatattccaacagg

SEQ ID NO: 1224 - DNA, 16 bp, Artificial sequence
  Synthetic oligonucleotide
gtgaaaacactcatgg

SEQ ID NO: 1225 - DNA, 16 bp, Artificial sequence
  Synthetic oligonucleotide
gctgagataggaagca

SEQ ID NO: 1226 - DNA, 16 bp, Artificial sequence
  Synthetic oligonucleotide
agtaaacttggctgtg

SEQ ID NO: 1227 - DNA, 16 bp, Artificial sequence
  Synthetic oligonucleotide
tggtaggtaggcacct

SEQ ID NO: 1228 - DNA, 16 bp, Artificial sequence
  Synthetic oligonucleotide
cttcactacctgcagc

SEQ ID NO: 1229 - DNA, 16 bp, Artificial sequence
  Synthetic oligonucleotide
atagagccagagcagt

SEQ ID NO: 1230 - DNA, 16 bp, Artificial sequence
  Synthetic oligonucleotide
cactgaaccatgttcc

SEQ ID NO: 1231 - DNA, 16 bp, Artificial sequence
  Synthetic oligonucleotide
gcaactagcagggcac

SEQ ID NO: 1232 - DNA, 16 bp, Artificial sequence
  Synthetic oligonucleotide
agtgatgtcaggtttt

SEQ ID NO: 1233 - DNA, 16 bp, Artificial sequence
  Synthetic oligonucleotide
aggcacatcaatgttt

SEQ ID NO: 1234 - DNA, 16 bp, Artificial sequence
  Synthetic oligonucleotide
taaagatgccagaggg

SEQ ID NO: 1235 - DNA, 16 bp, Artificial sequence
  Synthetic oligonucleotide
cacgaggttgccgaga

SEQ ID NO: 1236 - DNA, 16 bp, Artificial sequence
  Synthetic oligonucleotide
ctgtatcatgcatacc

SEQ ID NO: 1237 - DNA, 16 bp, Artificial sequence
  Synthetic oligonucleotide
cactgaggccttaatg

SEQ ID NO: 1238 - DNA, 16 bp, Artificial sequence
  Synthetic oligonucleotide
aatgaaccctaagttt

SEQ ID NO: 1239 - DNA, 16 bp, Artificial sequence
  Synthetic oligonucleotide
aacaaaaggttcccgc

SEQ ID NO: 1240 - DNA, 16 bp, Artificial sequence
  Synthetic oligonucleotide
acagaagatctctact

SEQ ID NO: 1241 - DNA, 16 bp, Artificial sequence
  Synthetic oligonucleotide
gtacagtccactccac

SEQ ID NO: 1242 - DNA, 16 bp, Artificial sequence
  Synthetic oligonucleotide
ggcacatgagaaatca

SEQ ID NO: 1243 - DNA, 16 bp, Artificial sequence
  Synthetic oligonucleotide
aactgcagcaccgtgg

SEQ ID NO: 1244 - DNA, 16 bp, Artificial sequence
  Synthetic oligonucleotide
tcacgcagtgcacctg

SEQ ID NO: 1245 - DNA, 16 bp, Artificial sequence
  Synthetic oligonucleotide
tgagaaagcatggctc

SEQ ID NO: 1246 - DNA, 16 bp, Artificial sequence
  Synthetic oligonucleotide
agctaacttacaggac

SEQ ID NO: 1247 - DNA, 16 bp, Artificial sequence
  Synthetic oligonucleotide
gtacacaagacaaatc

SEQ ID NO: 1248 - DNA, 16 bp, Artificial sequence
  Synthetic oligonucleotide
tgcctgaactgtgtaa

SEQ ID NO: 1249 - DNA, 16 bp, Artificial sequence
  Synthetic oligonucleotide
aggtagtagaccacag

SEQ ID NO: 1250 - DNA, 16 bp, Artificial sequence
  Synthetic oligonucleotide
gaacacaccaggttaa

SEQ ID NO: 1251 - DNA, 16 bp, Artificial sequence
  Synthetic oligonucleotide
ctagtttaagggttac

SEQ ID NO: 1252 - DNA, 16 bp, Artificial sequence
  Synthetic oligonucleotide
ctacaaaatgcctcca

SEQ ID NO: 1253 - DNA, 16 bp, Artificial sequence
  Synthetic oligonucleotide
agaaaactctaaccct

SEQ ID NO: 1254 - DNA, 16 bp, Artificial sequence
  Synthetic oligonucleotide
gattatatactggttg

SEQ ID NO: 1255 - DNA, 16 bp, Artificial sequence
  Synthetic oligonucleotide
gacttagaggacagtg

SEQ ID NO: 1256 - DNA, 16 bp, Artificial sequence
  Synthetic oligonucleotide
ctgtatagttctcaac

SEQ ID NO: 1257 - DNA, 16 bp, Artificial sequence
  Synthetic oligonucleotide
attttttggttagtcc

SEQ ID NO: 1258 - DNA, 16 bp, Artificial sequence
  Synthetic oligonucleotide
aacagagacgcggtga

SEQ ID NO: 1259 - DNA, 16 bp, Artificial sequence
  Synthetic oligonucleotide
caagatcgagcggtga

SEQ ID NO: 1260 - DNA, 16 bp, Artificial sequence
  Synthetic oligonucleotide
ttcaaagcgcaccgca

SEQ ID NO: 1261 - DNA, 16 bp, Artificial sequence
  Synthetic oligonucleotide
tgccagtggtggccgc

SEQ ID NO: 1262 - DNA, 16 bp, Artificial sequence
  Synthetic oligonucleotide
tctgacaagaactgct

SEQ ID NO: 1263 - DNA, 16 bp, Artificial sequence
  Synthetic oligonucleotide
tggcggatagatctgt

SEQ ID NO: 1264 - DNA, 16 bp, Artificial sequence
  Synthetic oligonucleotide
cctcaaccgctgaact

SEQ ID NO: 1265 - DNA, 16 bp, Artificial sequence
  Synthetic oligonucleotide
attaaagagcgcattt

SEQ ID NO: 1266 - DNA, 16 bp, Artificial sequence
  Synthetic oligonucleotide
agacatacctacaagc

SEQ ID NO: 1267 - DNA, 16 bp, Artificial sequence
  Synthetic oligonucleotide
aggaaaccgctggcag

SEQ ID NO: 1268 - DNA, 16 bp, Artificial sequence
  Synthetic oligonucleotide
acttagacattactag

SEQ ID NO: 1269 - DNA, 16 bp, Artificial sequence
  Synthetic oligonucleotide
gttaagtacttggaca

SEQ ID NO: 1270 - DNA, 16 bp, Artificial sequence
  Synthetic oligonucleotide
ggcacgaggaagcata

SEQ ID NO: 1271 - DNA, 16 bp, Artificial sequence
  Synthetic oligonucleotide
atacttaagcaagtgg

SEQ ID NO: 1272 - DNA, 16 bp, Artificial sequence
  Synthetic oligonucleotide
ctgtagtatgagaaac

SEQ ID NO: 1273 - DNA, 16 bp, Artificial sequence
  Synthetic oligonucleotide
gataaaggctgaactg

SEQ ID NO: 1274 - DNA, 16 bp, Artificial sequence
  Synthetic oligonucleotide
ctgcatgaaagtgtgt

SEQ ID NO: 1275 - DNA, 16 bp, Artificial sequence
  Synthetic oligonucleotide
cctactgggtacatgg

SEQ ID NO: 1276 - DNA, 16 bp, Artificial sequence
  Synthetic oligonucleotide
atgtatacatcactgc

SEQ ID NO: 1277 - DNA, 16 bp, Artificial sequence
  Synthetic oligonucleotide
cctgagacagacttcc

SEQ ID NO: 1278 - DNA, 16 bp, Artificial sequence
  Synthetic oligonucleotide
gtatttcatagctagt

SEQ ID NO: 1279 - DNA, 16 bp, Artificial sequence
  Synthetic oligonucleotide
ctgcttgaggttttcc

SEQ ID NO: 1280 - DNA, 16 bp, Artificial sequence
  Synthetic oligonucleotide
gttcatacccaatagt

SEQ ID NO: 1281 - DNA, 16 bp, Artificial sequence
  Synthetic oligonucleotide
atttatgccctcgctc

SEQ ID NO: 1282 - DNA, 16 bp, Artificial sequence
  Synthetic oligonucleotide
aaaagtaactgacacg

SEQ ID NO: 1283 - DNA, 16 bp, Artificial sequence
  Synthetic oligonucleotide
taaagaccttaaccaa

SEQ ID NO: 1284 - DNA, 16 bp, Artificial sequence
  Synthetic oligonucleotide
ttatgcatgttcctca

SEQ ID NO: 1285 - DNA, 16 bp, Artificial sequence
  Synthetic oligonucleotide
ctacagatctcagcaa

SEQ ID NO: 1286 - DNA, 16 bp, Artificial sequence
  Synthetic oligonucleotide
tataccaacgacagca

SEQ ID NO: 1287 - DNA, 16 bp, Artificial sequence
  Synthetic oligonucleotide
tttatatatgacgact

SEQ ID NO: 1288 - DNA, 16 bp, Artificial sequence
  Synthetic oligonucleotide
tagcagaggttctacc

SEQ ID NO: 1289 - DNA, 16 bp, Artificial sequence
  Synthetic oligonucleotide
aggaacgaagagcagg

SEQ ID NO: 1290 - DNA, 16 bp, Artificial sequence
  Synthetic oligonucleotide
gggattccgcgcgcag

SEQ ID NO: 1291 - DNA, 16 bp, Artificial sequence
  Synthetic oligonucleotide
gcccaaaggctcccga

SEQ ID NO: 1292 - DNA, 16 bp, Artificial sequence
  Synthetic oligonucleotide
ccggagaccttgaaga

SEQ ID NO: 1293 - DNA, 16 bp, Artificial sequence
  Synthetic oligonucleotide
aaacagagacgcggtg

SEQ ID NO: 1294 - DNA, 16 bp, Artificial sequence
  Synthetic oligonucleotide
acccacccagtgtctg

SEQ ID NO: 1295 - DNA, 16 bp, Artificial sequence
  Synthetic oligonucleotide
ttgcataggcatcctt

SEQ ID NO: 1296 - DNA, 16 bp, Artificial sequence
  Synthetic oligonucleotide
gtgattaattctccta

SEQ ID NO: 1297 - DNA, 16 bp, Artificial sequence
  Synthetic oligonucleotide
cactttaaaagttgac

SEQ ID NO: 1298 - DNA, 16 bp, Artificial sequence
  Synthetic oligonucleotide
gaatgcataacacggt

SEQ ID NO: 1299 - DNA, 16 bp, Artificial sequence
  Synthetic oligonucleotide
gagaagcatattccaa

SEQ ID NO: 1300 - DNA, 16 bp, Artificial sequence
  Synthetic oligonucleotide
cttcatcagactaagt

SEQ ID NO: 1301 - DNA, 16 bp, Artificial sequence
  Synthetic oligonucleotide
ggctgagataggaagc

SEQ ID NO: 1302 - DNA, 16 bp, Artificial sequence
  Synthetic oligonucleotide
gagtaaacttggctgt

SEQ ID NO: 1303 - DNA, 16 bp, Artificial sequence
  Synthetic oligonucleotide
acccagtggtaggtag

SEQ ID NO: 1304 - DNA, 16 bp, Artificial sequence
  Synthetic oligonucleotide
gtacacctcttcacta

SEQ ID NO: 1305 - DNA, 16 bp, Artificial sequence
  Synthetic oligonucleotide
catagagccagagcag

SEQ ID NO: 1306 - DNA, 16 bp, Artificial sequence
  Synthetic oligonucleotide
gccaaagagcccaatt

SEQ ID NO: 1307 - DNA, 16 bp, Artificial sequence
  Synthetic oligonucleotide
gtccgacgcaccgcgg

SEQ ID NO: 1308 - DNA, 16 bp, Artificial sequence
  Synthetic oligonucleotide
acaagcagtgatgtca

SEQ ID NO: 1309 - DNA, 16 bp, Artificial sequence
  Synthetic oligonucleotide
ctcttaggcacatcaa

SEQ ID NO: 1310 - DNA, 16 bp, Artificial sequence
  Synthetic oligonucleotide
ttaaagatgccagagg

SEQ ID NO: 1311 - DNA, 16 bp, Artificial sequence
  Synthetic oligonucleotide
tcacgaggttgccgag

SEQ ID NO: 1312 - DNA, 16 bp, Artificial sequence
  Synthetic oligonucleotide
ctgataattaatctgt

SEQ ID NO: 1313 - DNA, 16 bp, Artificial sequence
  Synthetic oligonucleotide
gggtaagcactgaggc

SEQ ID NO: 1314 - DNA, 16 bp, Artificial sequence
  Synthetic oligonucleotide
tttaagtcatgtgtca

SEQ ID NO: 1315 - DNA, 16 bp, Artificial sequence
  Synthetic oligonucleotide
gaacaaaaggttcccg

SEQ ID NO: 1316 - DNA, 16 bp, Artificial sequence
  Synthetic oligonucleotide
gacagaagatctctac

SEQ ID NO: 1317 - DNA, 16 bp, Artificial sequence
  Synthetic oligonucleotide
aaccagtacagtccac

SEQ ID NO: 1318 - DNA, 16 bp, Artificial sequence
  Synthetic oligonucleotide
aggcacatgagaaatc

SEQ ID NO: 1319 - DNA, 16 bp, Artificial sequence
  Synthetic oligonucleotide
ggcaatggagtctcgc

SEQ ID NO: 1320 - DNA, 16 bp, Artificial sequence
  Synthetic oligonucleotide
tctcacgcagtgcacc

SEQ ID NO: 1321 - DNA, 16 bp, Artificial sequence
  Synthetic oligonucleotide
gcacaattctctgaga

SEQ ID NO: 1322 - DNA, 16 bp, Artificial sequence
  Synthetic oligonucleotide
tatcaaagatctccac

SEQ ID NO: 1323 - DNA, 16 bp, Artificial sequence
  Synthetic oligonucleotide
ctttagcccatgctcc

SEQ ID NO: 1324 - DNA, 16 bp, Artificial sequence
  Synthetic oligonucleotide
cactatgcctgaactg

SEQ ID NO: 1325 - DNA, 16 bp, Artificial sequence
  Synthetic oligonucleotide
tcaaaaggtagtagac

SEQ ID NO: 1326 - DNA, 16 bp, Artificial sequence
  Synthetic oligonucleotide
caccgaacacaccagg

SEQ ID NO: 1327 - DNA, 16 bp, Artificial sequence
  Synthetic oligonucleotide
tcagactgtgctgctc

SEQ ID NO: 1328 - DNA, 16 bp, Artificial sequence
  Synthetic oligonucleotide
cctacaaaatgcctcc

SEQ ID NO: 1329 - DNA, 16 bp, Artificial sequence
  Synthetic oligonucleotide
gttatctatggaaacc

SEQ ID NO: 1330 - DNA, 16 bp, Artificial sequence
  Synthetic oligonucleotide
ggattatatactggtt

SEQ ID NO: 1331 - DNA, 16 bp, Artificial sequence
  Synthetic oligonucleotide
atggaccacgcagcct

SEQ ID NO: 1332 - DNA, 16 bp, Artificial sequence
  Synthetic oligonucleotide
aggtaatctgtatagt

SEQ ID NO: 1333 - DNA, 16 bp, Artificial sequence
  Synthetic oligonucleotide
ttcatatttggagcca

SEQ ID NO: 1334 - DNA, 16 bp, Artificial sequence
  Synthetic oligonucleotide
gcccggaggaagggcg

SEQ ID NO: 1335 - DNA, 16 bp, Artificial sequence
  Synthetic oligonucleotide
cccaagatcgagcggt

SEQ ID NO: 1336 - DNA, 16 bp, Artificial sequence
  Synthetic oligonucleotide
gttcaaagcgcaccgc

SEQ ID NO: 1337 - DNA, 16 bp, Artificial sequence
  Synthetic oligonucleotide
acaagctgggccttgc

SEQ ID NO: 1338 - DNA, 16 bp, Artificial sequence
  Synthetic oligonucleotide
ggagatccggcagccc

SEQ ID NO: 1339 - DNA, 16 bp, Artificial sequence
  Synthetic oligonucleotide
acgcttgcagctctga

SEQ ID NO: 1340 - DNA, 16 bp, Artificial sequence
  Synthetic oligonucleotide
ggaatggcggatagat

SEQ ID NO: 1341 - DNA, 16 bp, Artificial sequence
  Synthetic oligonucleotide
tcctcaaccgctgaac

SEQ ID NO: 1342 - DNA, 16 bp, Artificial sequence
  Synthetic oligonucleotide
aattaaagagcgcatt

SEQ ID NO: 1343 - DNA, 16 bp, Artificial sequence
  Synthetic oligonucleotide
cagacatacctacaag

SEQ ID NO: 1344 - DNA, 16 bp, Artificial sequence
  Synthetic oligonucleotide
caggaaaccgctggca

SEQ ID NO: 1345 - DNA, 16 bp, Artificial sequence
  Synthetic oligonucleotide
tacttagacattacta

SEQ ID NO: 1346 - DNA, 16 bp, Artificial sequence
  Synthetic oligonucleotide
tagttaagtacttgga

SEQ ID NO: 1347 - DNA, 16 bp, Artificial sequence
  Synthetic oligonucleotide
tggcacgaggaagcat

SEQ ID NO: 1348 - DNA, 16 bp, Artificial sequence
  Synthetic oligonucleotide
tatacttaagcaagtg

SEQ ID NO: 1349 - DNA, 16 bp, Artificial sequence
  Synthetic oligonucleotide
cctgtagtatgagaaa

SEQ ID NO: 1350 - DNA, 16 bp, Artificial sequence
  Synthetic oligonucleotide
ttgataaaggctgaac

SEQ ID NO: 1351 - DNA, 16 bp, Artificial sequence
  Synthetic oligonucleotide
gagcactgcatgaaag

SEQ ID NO: 1352 - DNA, 16 bp, Artificial sequence
  Synthetic oligonucleotide
ccctactgggtacatg

SEQ ID NO: 1353 - DNA, 16 bp, Artificial sequence
  Synthetic oligonucleotide
gatgtatacatcactg

SEQ ID NO: 1354 - DNA, 16 bp, Artificial sequence
  Synthetic oligonucleotide
gagcatccgcttggag

SEQ ID NO: 1355 - DNA, 16 bp, Artificial sequence
  Synthetic oligonucleotide
gagtatttcatagcta

SEQ ID NO: 1356 - DNA, 16 bp, Artificial sequence
  Synthetic oligonucleotide
actgcttgaggttttc

SEQ ID NO: 1357 - DNA, 16 bp, Artificial sequence
  Synthetic oligonucleotide
ttttagttcataccca

SEQ ID NO: 1358 - DNA, 16 bp, Artificial sequence
  Synthetic oligonucleotide
tatttatgccctcgct

SEQ ID NO: 1359 - DNA, 16 bp, Artificial sequence
  Synthetic oligonucleotide
tctgaattgttactaa

SEQ ID NO: 1360 - DNA, 16 bp, Artificial sequence
  Synthetic oligonucleotide
aataaagaccttaacc

SEQ ID NO: 1361 - DNA, 16 bp, Artificial sequence
  Synthetic oligonucleotide
tcttatgcatgttcct

SEQ ID NO: 1362 - DNA, 16 bp, Artificial sequence
  Synthetic oligonucleotide
aagcatcctttcctac

SEQ ID NO: 1363 - DNA, 16 bp, Artificial sequence
  Synthetic oligonucleotide
gtataccaacgacagc

SEQ ID NO: 1364 - DNA, 16 bp, Artificial sequence
  Synthetic oligonucleotide
ttttatatatgacgac

SEQ ID NO: 1365 - DNA, 16 bp, Artificial sequence
  Synthetic oligonucleotide
gaggacttcgggagat

SEQ ID NO: 1366 - DNA, 16 bp, Artificial sequence
  Synthetic oligonucleotide
ttaggaacgaagagca

SEQ ID NO: 1367 - DNA, 16 bp, Artificial sequence
  Synthetic oligonucleotide
gacaagtggcgcagac

SEQ ID NO: 1368 - DNA, 16 bp, Artificial sequence
  Synthetic oligonucleotide
ctcctacccgcctgct

SEQ ID NO: 1369 - DNA, 16 bp, Artificial sequence
  Synthetic oligonucleotide
ggccggagaccttgaa

SEQ ID NO: 1370 - DNA, 16 bp, Artificial sequence
  Synthetic oligonucleotide
cggcagacgggagccc

SEQ ID NO: 1371 - DNA, 16 bp, Artificial sequence
  Synthetic oligonucleotide
gaaacagagacgcggt

SEQ ID NO: 1372 - DNA, 16 bp, Artificial sequence
  Synthetic oligonucleotide
gcggaggttccttgag

SEQ ID NO: 1373 - DNA, 16 bp, Artificial sequence
  Synthetic oligonucleotide
catacagtgtgattaa

SEQ ID NO: 1374 - DNA, 16 bp, Artificial sequence
  Synthetic oligonucleotide
gaccatgttacacttt

SEQ ID NO: 1375 - DNA, 16 bp, Artificial sequence
  Synthetic oligonucleotide
ttagaatgcataacac

SEQ ID NO: 1376 - DNA, 16 bp, Artificial sequence
  Synthetic oligonucleotide
tgagaagcatattcca

SEQ ID NO: 1377 - DNA, 16 bp, Artificial sequence
  Synthetic oligonucleotide
ctggagtgaacccttc

SEQ ID NO: 1378 - DNA, 16 bp, Artificial sequence
  Synthetic oligonucleotide
agaagcactggcatcg

SEQ ID NO: 1379 - DNA, 16 bp, Artificial sequence
  Synthetic oligonucleotide
tgagagtaaacttggc

SEQ ID NO: 1380 - DNA, 16 bp, Artificial sequence
  Synthetic oligonucleotide
atccacaatcagcaag

SEQ ID NO: 1381 - DNA, 16 bp, Artificial sequence
  Synthetic oligonucleotide
tggtacacctcttcac

SEQ ID NO: 1382 - DNA, 16 bp, Artificial sequence
  Synthetic oligonucleotide
ccatagagccagagca

SEQ ID NO: 1383 - DNA, 16 bp, Artificial sequence
  Synthetic oligonucleotide
gtctacttgagtctgt

SEQ ID NO: 1384 - DNA, 16 bp, Artificial sequence
  Synthetic oligonucleotide
gacagagagtccgacg

SEQ ID NO: 1385 - DNA, 16 bp, Artificial sequence
  Synthetic oligonucleotide
cacaagcagtgatgtc

SEQ ID NO: 1386 - DNA, 16 bp, Artificial sequence
  Synthetic oligonucleotide
tactcttaggcacatc

SEQ ID NO: 1387 - DNA, 16 bp, Artificial sequence
  Synthetic oligonucleotide
tcagaatttagttagt

SEQ ID NO: 1388 - DNA, 16 bp, Artificial sequence
  Synthetic oligonucleotide
atcacgaggttgccga

SEQ ID NO: 1389 - DNA, 16 bp, Artificial sequence
  Synthetic oligonucleotide
ggctgataattaatct

SEQ ID NO: 1390 - DNA, 16 bp, Artificial sequence
  Synthetic oligonucleotide
attaaagggtaagcac

SEQ ID NO: 1391 - DNA, 16 bp, Artificial sequence
  Synthetic oligonucleotide
tgatagtggtgatgtc

SEQ ID NO: 1392 - DNA, 16 bp, Artificial sequence
  Synthetic oligonucleotide
ggaacaaaaggttccc

SEQ ID NO: 1393 - DNA, 16 bp, Artificial sequence
  Synthetic oligonucleotide
tctgatccggactctc

SEQ ID NO: 1394 - DNA, 16 bp, Artificial sequence
  Synthetic oligonucleotide
caaaaccagtacagtc

SEQ ID NO: 1395 - DNA, 16 bp, Artificial sequence
  Synthetic oligonucleotide
ccagagcacacagacg

SEQ ID NO: 1396 - DNA, 16 bp, Artificial sequence
  Synthetic oligonucleotide
gggcaatggagtctcg

SEQ ID NO: 1397 - DNA, 16 bp, Artificial sequence
  Synthetic oligonucleotide
gtctctcacgcagtgc

SEQ ID NO: 1398 - DNA, 16 bp, Artificial sequence
  Synthetic oligonucleotide
ggcacaattctctgag

SEQ ID NO: 1399 - DNA, 16 bp, Artificial sequence
  Synthetic oligonucleotide
gatatcaaagatctcc

SEQ ID NO: 1400 - DNA, 16 bp, Artificial sequence
  Synthetic oligonucleotide
aaagacaagtgcccat

SEQ ID NO: 1401 - DNA, 16 bp, Artificial sequence
  Synthetic oligonucleotide
tgtcactatgcctgaa

SEQ ID NO: 1402 - DNA, 16 bp, Artificial sequence
  Synthetic oligonucleotide
acgaagattcaaaagg

SEQ ID NO: 1403 - DNA, 16 bp, Artificial sequence
  Synthetic oligonucleotide
catcaccgaacacacc

SEQ ID NO: 1404 - DNA, 16 bp, Artificial sequence
  Synthetic oligonucleotide
cctcagactgtgctgc

SEQ ID NO: 1405 - DNA, 16 bp, Artificial sequence
  Synthetic oligonucleotide
acctacaaaatgcctc

SEQ ID NO: 1406 - DNA, 16 bp, Artificial sequence
  Synthetic oligonucleotide
ggcaaattaatgcttc

SEQ ID NO: 1407 - DNA, 16 bp, Artificial sequence
  Synthetic oligonucleotide
tctatgggattatata

SEQ ID NO: 1408 - DNA, 16 bp, Artificial sequence
  Synthetic oligonucleotide
ttatggaccacgcagc

SEQ ID NO: 1409 - DNA, 16 bp, Artificial sequence
  Synthetic oligonucleotide
ttctaggtaatctgta

SEQ ID NO: 1410 - DNA, 16 bp, Artificial sequence
  Synthetic oligonucleotide
tttcatatttggagcc

SEQ ID NO: 1411 - DNA, 16 bp, Artificial sequence
  Synthetic oligonucleotide
agtagctgggccctcg

SEQ ID NO: 1412 - DNA, 16 bp, Artificial sequence
  Synthetic oligonucleotide
cctcaaagtcattgct

SEQ ID NO: 1413 - DNA, 16 bp, Artificial sequence
  Synthetic oligonucleotide
tcccaagatcgagcgg

SEQ ID NO: 1414 - DNA, 16 bp, Artificial sequence
  Synthetic oligonucleotide
tcacaagctgggcctt

SEQ ID NO: 1415 - DNA, 16 bp, Artificial sequence
  Synthetic oligonucleotide
catgggagatccggca

SEQ ID NO: 1416 - DNA, 16 bp, Artificial sequence
  Synthetic oligonucleotide
ccgtggtgagcaaacg

SEQ ID NO: 1417 - DNA, 16 bp, Artificial sequence
  Synthetic oligonucleotide
aggaatggcggataga

SEQ ID NO: 1418 - DNA, 16 bp, Artificial sequence
  Synthetic oligonucleotide
cgcaattctcctcaac

SEQ ID NO: 1419 - DNA, 16 bp, Artificial sequence
  Synthetic oligonucleotide
aaattaaagagcgcat

SEQ ID NO: 1420 - DNA, 16 bp, Artificial sequence
  Synthetic oligonucleotide
ggcacagacataccta

SEQ ID NO: 1421 - DNA, 16 bp, Artificial sequence
  Synthetic oligonucleotide
caccaggaaaccgctg

SEQ ID NO: 1422 - DNA, 16 bp, Artificial sequence
  Synthetic oligonucleotide
cattacttagacatta

SEQ ID NO: 1423 - DNA, 16 bp, Artificial sequence
  Synthetic oligonucleotide
atagttaagtacttgg

SEQ ID NO: 1424 - DNA, 16 bp, Artificial sequence
  Synthetic oligonucleotide
tataattggcacgagg

SEQ ID NO: 1425 - DNA, 16 bp, Artificial sequence
  Synthetic oligonucleotide
gtatacttaagcaagt

SEQ ID NO: 1426 - DNA, 16 bp, Artificial sequence
  Synthetic oligonucleotide
atcctgtagtatgaga

SEQ ID NO: 1427 - DNA, 16 bp, Artificial sequence
  Synthetic oligonucleotide
cttgataaaggctgaa

SEQ ID NO: 1428 - DNA, 16 bp, Artificial sequence
  Synthetic oligonucleotide
gctacaaagagcactg

SEQ ID NO: 1429 - DNA, 16 bp, Artificial sequence
  Synthetic oligonucleotide
tcaaaccctactgggt

SEQ ID NO: 1430 - DNA, 16 bp, Artificial sequence
  Synthetic oligonucleotide
tctataagatgtatac

SEQ ID NO: 1431 - DNA, 16 bp, Artificial sequence
  Synthetic oligonucleotide
aatggagcatccgctt

SEQ ID NO: 1432 - DNA, 16 bp, Artificial sequence
  Synthetic oligonucleotide
tgctaggattcctaac

SEQ ID NO: 1433 - DNA, 16 bp, Artificial sequence
  Synthetic oligonucleotide
tactgcttgaggtttt

SEQ ID NO: 1434 - DNA, 16 bp, Artificial sequence
  Synthetic oligonucleotide
tttttagttcataccc

SEQ ID NO: 1435 - DNA, 16 bp, Artificial sequence
  Synthetic oligonucleotide
gtatttatgccctcgc

SEQ ID NO: 1436 - DNA, 16 bp, Artificial sequence
  Synthetic oligonucleotide
atctgaattgttacta

SEQ ID NO: 1437 - DNA, 16 bp, Artificial sequence
  Synthetic oligonucleotide
caccattcagacagat

SEQ ID NO: 1438 - DNA, 16 bp, Artificial sequence
  Synthetic oligonucleotide
ctacatttcttatgca

SEQ ID NO: 1439 - DNA, 16 bp, Artificial sequence
  Synthetic oligonucleotide
tgtgaagcatcctttc

SEQ ID NO: 1440 - DNA, 16 bp, Artificial sequence
  Synthetic oligonucleotide
tgtataccaacgacag

SEQ ID NO: 1441 - DNA, 16 bp, Artificial sequence
  Synthetic oligonucleotide
gatattagagactgta

SEQ ID NO: 1442 - DNA, 16 bp, Artificial sequence
  Synthetic oligonucleotide
acagaggacttcggga

SEQ ID NO: 1443 - DNA, 16 bp, Artificial sequence
  Synthetic oligonucleotide
cttaggaacgaagagc

SEQ ID NO: 1444 - DNA, 16 bp, Artificial sequence
  Synthetic oligonucleotide
aaacgacaagtggcgc

SEQ ID NO: 1445 - DNA, 16 bp, Artificial sequence
  Synthetic oligonucleotide
gcgaaggctcctaccc

SEQ ID NO: 1446 - DNA, 16 bp, Artificial sequence
  Synthetic oligonucleotide
cccgaggccggagacc

SEQ ID NO: 1447 - DNA, 16 bp, Artificial sequence
  Synthetic oligonucleotide
gacggaggcggcagac

SEQ ID NO: 1448 - DNA, 16 bp, Artificial sequence
  Synthetic oligonucleotide
gaaaagcagcgaaaag

SEQ ID NO: 1449 - DNA, 16 bp, Artificial sequence
  Synthetic oligonucleotide
ggtagagtgagatgcg

SEQ ID NO: 1450 - DNA, 16 bp, Artificial sequence
  Synthetic oligonucleotide
gttctagggtcctcct

SEQ ID NO: 1451 - DNA, 16 bp, Artificial sequence
  Synthetic oligonucleotide
ggcatacagtgtgatt

SEQ ID NO: 1452 - DNA, 16 bp, Artificial sequence
  Synthetic oligonucleotide
agctgaccatgttaca

SEQ ID NO: 1453 - DNA, 16 bp, Artificial sequence
  Synthetic oligonucleotide
cttagaatgcataaca

SEQ ID NO: 1454 - DNA, 16 bp, Artificial sequence
  Synthetic oligonucleotide
ggcactacttccaaaa

SEQ ID NO: 1455 - DNA, 16 bp, Artificial sequence
  Synthetic oligonucleotide
ccgaaaagactggagt

SEQ ID NO: 1456 - DNA, 16 bp, Artificial sequence
  Synthetic oligonucleotide
aagaagcactggcatc

SEQ ID NO: 1457 - DNA, 16 bp, Artificial sequence
  Synthetic oligonucleotide
cctgagagtaaacttg

SEQ ID NO: 1458 - DNA, 16 bp, Artificial sequence
  Synthetic oligonucleotide
ctaatccacaatcagc

SEQ ID NO: 1459 - DNA, 16 bp, Artificial sequence
  Synthetic oligonucleotide
ttaaagagtggtacac

SEQ ID NO: 1460 - DNA, 16 bp, Artificial sequence
  Synthetic oligonucleotide
ttccatagagccagag

SEQ ID NO: 1461 - DNA, 16 bp, Artificial sequence
  Synthetic oligonucleotide
caaagcgggttcacaa

SEQ ID NO: 1462 - DNA, 16 bp, Artificial sequence
  Synthetic oligonucleotide
agacagagagtccgac

SEQ ID NO: 1463 - DNA, 16 bp, Artificial sequence
  Synthetic oligonucleotide
aaccacaagcagtgat

SEQ ID NO: 1464 - DNA, 16 bp, Artificial sequence
  Synthetic oligonucleotide
gtattactcttaggca

SEQ ID NO: 1465 - DNA, 16 bp, Artificial sequence
  Synthetic oligonucleotide
gccacaactctcgcct

SEQ ID NO: 1466 - DNA, 16 bp, Artificial sequence
  Synthetic oligonucleotide
gaaatcacgaggttgc

SEQ ID NO: 1467 - DNA, 16 bp, Artificial sequence
  Synthetic oligonucleotide
tctaataaatgtgctc

SEQ ID NO: 1468 - DNA, 16 bp, Artificial sequence
  Synthetic oligonucleotide
cacattaaagggtaag

SEQ ID NO: 1469 - DNA, 16 bp, Artificial sequence
  Synthetic oligonucleotide
actattaagaacttgc

SEQ ID NO: 1470 - DNA, 16 bp, Artificial sequence
  Synthetic oligonucleotide
gggaacaaaaggttcc

SEQ ID NO: 1471 - DNA, 16 bp, Artificial sequence
  Synthetic oligonucleotide
atctgatccggactct

SEQ ID NO: 1472 - DNA, 16 bp, Artificial sequence
  Synthetic oligonucleotide
gcaaaaccagtacagt

SEQ ID NO: 1473 - DNA, 16 bp, Artificial sequence
  Synthetic oligonucleotide
caacagtgccagagca

SEQ ID NO: 1474 - DNA, 16 bp, Artificial sequence
  Synthetic oligonucleotide
tcctatggtcagcctc

SEQ ID NO: 1475 - DNA, 16 bp, Artificial sequence
  Synthetic oligonucleotide
cgcaagtctacagccc

SEQ ID NO: 1476 - DNA, 16 bp, Artificial sequence
  Synthetic oligonucleotide
tggcacaattctctga

SEQ ID NO: 1477 - DNA, 16 bp, Artificial sequence
  Synthetic oligonucleotide
gaataggaagatatca

SEQ ID NO: 1478 - DNA, 16 bp, Artificial sequence
  Synthetic oligonucleotide
ggaaagacaagtgccc

SEQ ID NO: 1479 - DNA, 16 bp, Artificial sequence
  Synthetic oligonucleotide
tcccactgtcactatg

SEQ ID NO: 1480 - DNA, 16 bp, Artificial sequence
  Synthetic oligonucleotide
cacgaagattcaaaag

SEQ ID NO: 1481 - DNA, 16 bp, Artificial sequence
  Synthetic oligonucleotide
agaaaccctcatcacc

SEQ ID NO: 1482 - DNA, 16 bp, Artificial sequence
  Synthetic oligonucleotide
ctttgatgagcagatc

SEQ ID NO: 1483 - DNA, 16 bp, Artificial sequence
  Synthetic oligonucleotide
gagacctacaaaatgc

SEQ ID NO: 1484 - DNA, 16 bp, Artificial sequence
  Synthetic oligonucleotide
gtcttaagggttcaag

SEQ ID NO: 1485 - DNA, 16 bp, Artificial sequence
  Synthetic oligonucleotide
gtctatgggattatat

SEQ ID NO: 1486 - DNA, 16 bp, Artificial sequence
  Synthetic oligonucleotide
tttatggaccacgcag

SEQ ID NO: 1487 - DNA, 16 bp, Artificial sequence
  Synthetic oligonucleotide
gatttctaggtaatct

SEQ ID NO: 1488 - DNA, 16 bp, Artificial sequence
  Synthetic oligonucleotide
ttacatcctagaacac

SEQ ID NO: 1489 - DNA, 16 bp, Artificial sequence
  Synthetic oligonucleotide
ttgcatctataagatg

SEQ ID NO: 1490 - DNA, 16 bp, Artificial sequence
  Synthetic oligonucleotide
tcggagctgagggcag

SEQ ID NO: 1491 - DNA, 16 bp, Artificial sequence
  Synthetic oligonucleotide
gctcaaccagttcctc

SEQ ID NO: 1492 - DNA, 16 bp, Artificial sequence
  Synthetic oligonucleotide
ggcaaccattttcaca

SEQ ID NO: 1493 - DNA, 16 bp, Artificial sequence
  Synthetic oligonucleotide
gtccatgggagatccg

SEQ ID NO: 1494 - DNA, 16 bp, Artificial sequence
  Synthetic oligonucleotide
cagggagcggccgtgg

SEQ ID NO: 1495 - DNA, 16 bp, Artificial sequence
  Synthetic oligonucleotide
gaggaatggcggatag

SEQ ID NO: 1496 - DNA, 16 bp, Artificial sequence
  Synthetic oligonucleotide
ccgcaattctcctcaa

SEQ ID NO: 1497 - DNA, 16 bp, Artificial sequence
  Synthetic oligonucleotide
caaattaaagagcgca

SEQ ID NO: 1498 - DNA, 16 bp, Artificial sequence
  Synthetic oligonucleotide
tggcacagacatacct

SEQ ID NO: 1499 - DNA, 16 bp, Artificial sequence
  Synthetic oligonucleotide
ccacaccaggaaaccg

SEQ ID NO: 1500 - DNA, 16 bp, Artificial sequence
  Synthetic oligonucleotide
ccattacttagacatt

SEQ ID NO: 1501 - DNA, 16 bp, Artificial sequence
  Synthetic oligonucleotide
gatagttaagtacttg

SEQ ID NO: 1502 - DNA, 16 bp, Artificial sequence
  Synthetic oligonucleotide
aaactataattggcac

SEQ ID NO: 1503 - DNA, 16 bp, Artificial sequence
  Synthetic oligonucleotide
ggtatacttaagcaag

SEQ ID NO: 1504 - DNA, 16 bp, Artificial sequence
  Synthetic oligonucleotide
gtaaatatcctgtagt

SEQ ID NO: 1505 - DNA, 16 bp, Artificial sequence
  Synthetic oligonucleotide
gcttgataaaggctga

SEQ ID NO: 1506 - DNA, 16 bp, Artificial sequence
  Synthetic oligonucleotide
agctacaaagagcact

SEQ ID NO: 1507 - DNA, 16 bp, Artificial sequence
  Synthetic oligonucleotide
gtcaaaccctactggg

SEQ ID NO: 1508 - DNA, 16 bp, Artificial sequence
  Synthetic oligonucleotide
tgaaatggagcatccg

SEQ ID NO: 1509 - DNA, 16 bp, Artificial sequence
  Synthetic oligonucleotide
gacaagtgctaggatt

SEQ ID NO: 1510 - DNA, 16 bp, Artificial sequence
  Synthetic oligonucleotide
attactgcttgaggtt

SEQ ID NO: 1511 - DNA, 16 bp, Artificial sequence
  Synthetic oligonucleotide
ctttttagttcatacc

SEQ ID NO: 1512 - DNA, 16 bp, Artificial sequence
  Synthetic oligonucleotide
tgtatttatgccctcg

SEQ ID NO: 1513 - DNA, 16 bp, Artificial sequence
  Synthetic oligonucleotide
tggatctgaattgtta

SEQ ID NO: 1514 - DNA, 16 bp, Artificial sequence
  Synthetic oligonucleotide
acgcaccattcagaca

SEQ ID NO: 1515 - DNA, 16 bp, Artificial sequence
  Synthetic oligonucleotide
ggaggagggttggcct

SEQ ID NO: 1516 - DNA, 16 bp, Artificial sequence
  Synthetic oligonucleotide
ttgtgaagcatccttt

SEQ ID NO: 1517 - DNA, 16 bp, Artificial sequence
  Synthetic oligonucleotide
atgtataccaacgaca

SEQ ID NO: 1518 - DNA, 16 bp, Artificial sequence
  Synthetic oligonucleotide
tgatattagagactgt

SEQ ID NO: 1519 - DNA, 16 bp, Artificial sequence
  Synthetic oligonucleotide
ccacagaggacttcgg

SEQ ID NO: 1520 - DNA, 16 bp, Artificial sequence
  Synthetic oligonucleotide
cccttaggaacgaaga

SEQ ID NO: 1521 - DNA, 16 bp, Artificial sequence
  Synthetic oligonucleotide
tgcaaacgacaagtgg

SEQ ID NO: 1522 - DNA, 16 bp, Artificial sequence
  Synthetic oligonucleotide
cgcgaaggctcctacc

SEQ ID NO: 1523 - DNA, 16 bp, Artificial sequence
  Synthetic oligonucleotide
tcccgaggccggagac

SEQ ID NO: 1524 - DNA, 16 bp, Artificial sequence
  Synthetic oligonucleotide
acggacggaggcggca

SEQ ID NO: 1525 - DNA, 16 bp, Artificial sequence
  Synthetic oligonucleotide
cggtagagtgagatgc

SEQ ID NO: 1526 - DNA, 16 bp, Artificial sequence
  Synthetic oligonucleotide
catcgaactcctgagt

SEQ ID NO: 1527 - DNA, 16 bp, Artificial sequence
  Synthetic oligonucleotide
attgaggcatacagtg

SEQ ID NO: 1528 - DNA, 16 bp, Artificial sequence
  Synthetic oligonucleotide
aaacacctcagctgac

SEQ ID NO: 1529 - DNA, 16 bp, Artificial sequence
  Synthetic oligonucleotide
gacctaactaaatgtc

SEQ ID NO: 1530 - DNA, 16 bp, Artificial sequence
  Synthetic oligonucleotide
gataaggcactacttc

SEQ ID NO: 1531 - DNA, 16 bp, Artificial sequence
  Synthetic oligonucleotide
cattttatcatccgaa

SEQ ID NO: 1532 - DNA, 16 bp, Artificial sequence
  Synthetic oligonucleotide
ggaagcactggcattg

SEQ ID NO: 1533 - DNA, 16 bp, Artificial sequence
  Synthetic oligonucleotide
tagcatggatcctgag

SEQ ID NO: 1534 - DNA, 16 bp, Artificial sequence
  Synthetic oligonucleotide
tctaatccacaatcag

SEQ ID NO: 1535 - DNA, 16 bp, Artificial sequence
  Synthetic oligonucleotide
attaaagagtggtaca

SEQ ID NO: 1536 - DNA, 16 bp, Artificial sequence
  Synthetic oligonucleotide
ctaattccatagagcc

SEQ ID NO: 1537 - DNA, 16 bp, Artificial sequence
  Synthetic oligonucleotide
tcacaaagcgggttca

SEQ ID NO: 1538 - DNA, 16 bp, Artificial sequence
  Synthetic oligonucleotide
gtctagacagagagtc

SEQ ID NO: 1539 - DNA, 16 bp, Artificial sequence
  Synthetic oligonucleotide
agccagtggctgaaac

SEQ ID NO: 1540 - DNA, 16 bp, Artificial sequence
  Synthetic oligonucleotide
gtgtattactcttagg

SEQ ID NO: 1541 - DNA, 16 bp, Artificial sequence
  Synthetic oligonucleotide
tgccacaactctcgcc

SEQ ID NO: 1542 - DNA, 16 bp, Artificial sequence
  Synthetic oligonucleotide
agaaatcacgaggttg

SEQ ID NO: 1543 - DNA, 16 bp, Artificial sequence
  Synthetic oligonucleotide
tcaatgggaatcacag

SEQ ID NO: 1544 - DNA, 16 bp, Artificial sequence
  Synthetic oligonucleotide
acacattaaagggtaa

SEQ ID NO: 1545 - DNA, 16 bp, Artificial sequence
  Synthetic oligonucleotide
cactattaagaacttg

SEQ ID NO: 1546 - DNA, 16 bp, Artificial sequence
  Synthetic oligonucleotide
cccacatgtcccgtgg

SEQ ID NO: 1547 - DNA, 16 bp, Artificial sequence
  Synthetic oligonucleotide
ttgcaagagaacagcc

SEQ ID NO: 1548 - DNA, 16 bp, Artificial sequence
  Synthetic oligonucleotide
tgcaaaaccagtacag

SEQ ID NO: 1549 - DNA, 16 bp, Artificial sequence
  Synthetic oligonucleotide
agcacatgtcaacagt

SEQ ID NO: 1550 - DNA, 16 bp, Artificial sequence
  Synthetic oligonucleotide
aaccagcacagttctc

SEQ ID NO: 1551 - DNA, 16 bp, Artificial sequence
  Synthetic oligonucleotide
gcgcaagtctacagcc

SEQ ID NO: 1552 - DNA, 16 bp, Artificial sequence
  Synthetic oligonucleotide
atcagaatggcgagtt

SEQ ID NO: 1553 - DNA, 16 bp, Artificial sequence
  Synthetic oligonucleotide
acctgaataggaagat

SEQ ID NO: 1554 - DNA, 16 bp, Artificial sequence
  Synthetic oligonucleotide
ttggaaagacaagtgc

SEQ ID NO: 1555 - DNA, 16 bp, Artificial sequence
  Synthetic oligonucleotide
agccatcggcagctga

SEQ ID NO: 1556 - DNA, 16 bp, Artificial sequence
  Synthetic oligonucleotide
tggacccacgaagatt

SEQ ID NO: 1557 - DNA, 16 bp, Artificial sequence
  Synthetic oligonucleotide
cagaaaccctcatcac

SEQ ID NO: 1558 - DNA, 16 bp, Artificial sequence
  Synthetic oligonucleotide
aaagaggcaccctcct

SEQ ID NO: 1559 - DNA, 16 bp, Artificial sequence
  Synthetic oligonucleotide
tgctaggacacagctg

SEQ ID NO: 1560 - DNA, 16 bp, Artificial sequence
  Synthetic oligonucleotide
tcaaaagtcttaaggg

SEQ ID NO: 1561 - DNA, 16 bp, Artificial sequence
  Synthetic oligonucleotide
gagaaaactcctgagt

SEQ ID NO: 1562 - DNA, 16 bp, Artificial sequence
  Synthetic oligonucleotide
ttttatggaccacgca

SEQ ID NO: 1563 - DNA, 16 bp, Artificial sequence
  Synthetic oligonucleotide
cacaactgcagtttga

SEQ ID NO: 1564 - DNA, 16 bp, Artificial sequence
  Synthetic oligonucleotide
ccaaagttacatccta

SEQ ID NO: 1565 - DNA, 16 bp, Artificial sequence
  Synthetic oligonucleotide
ccgcagagagctagca

SEQ ID NO: 1566 - DNA, 16 bp, Artificial sequence
  Synthetic oligonucleotide
tggactcggagctgag

SEQ ID NO: 1567 - DNA, 16 bp, Artificial sequence
  Synthetic oligonucleotide
gtccagctggctccgc

SEQ ID NO: 1568 - DNA, 16 bp, Artificial sequence
  Synthetic oligonucleotide
tgtcacctggcaacca

SEQ ID NO: 1569 - DNA, 16 bp, Artificial sequence
  Synthetic oligonucleotide
gaacaggacctggtcc

SEQ ID NO: 1570 - DNA, 16 bp, Artificial sequence
  Synthetic oligonucleotide
agaggaatggcggata

SEQ ID NO: 1571 - DNA, 16 bp, Artificial sequence
  Synthetic oligonucleotide
acaaattaaagagcgc

SEQ ID NO: 1572 - DNA, 16 bp, Artificial sequence
  Synthetic oligonucleotide
ttacatcttacttccc

SEQ ID NO: 1573 - DNA, 16 bp, Artificial sequence
  Synthetic oligonucleotide
actaactggcttccag

SEQ ID NO: 1574 - DNA, 16 bp, Artificial sequence
  Synthetic oligonucleotide
accattacttagacat

SEQ ID NO: 1575 - DNA, 16 bp, Artificial sequence
  Synthetic oligonucleotide
agatagttaagtactt

SEQ ID NO: 1576 - DNA, 16 bp, Artificial sequence
  Synthetic oligonucleotide
tcaaactataattggc

SEQ ID NO: 1577 - DNA, 16 bp, Artificial sequence
  Synthetic oligonucleotide
aggtatacttaagcaa

SEQ ID NO: 1578 - DNA, 16 bp, Artificial sequence
  Synthetic oligonucleotide
tagtaaatatcctgta

SEQ ID NO: 1579 - DNA, 16 bp, Artificial sequence
  Synthetic oligonucleotide
agcttgataaaggctg

SEQ ID NO: 1580 - DNA, 16 bp, Artificial sequence
  Synthetic oligonucleotide
gttagctacaaagagc

SEQ ID NO: 1581 - DNA, 16 bp, Artificial sequence
  Synthetic oligonucleotide
tgtcaaaccctactgg

SEQ ID NO: 1582 - DNA, 16 bp, Artificial sequence
  Synthetic oligonucleotide
ccccaaaatactttgc

SEQ ID NO: 1583 - DNA, 16 bp, Artificial sequence
  Synthetic oligonucleotide
ttgaaatggagcatcc

SEQ ID NO: 1584 - DNA, 16 bp, Artificial sequence
  Synthetic oligonucleotide
agacaagtgctaggat

SEQ ID NO: 1585 - DNA, 16 bp, Artificial sequence
  Synthetic oligonucleotide
ggagatattaattact

SEQ ID NO: 1586 - DNA, 16 bp, Artificial sequence
  Synthetic oligonucleotide
gctcatttcactgtag

SEQ ID NO: 1587 - DNA, 16 bp, Artificial sequence
  Synthetic oligonucleotide
ctgtatttatgccctc

SEQ ID NO: 1588 - DNA, 16 bp, Artificial sequence
  Synthetic oligonucleotide
acactggatctgaatt

SEQ ID NO: 1589 - DNA, 16 bp, Artificial sequence
  Synthetic oligonucleotide
agccttcacgcaccat

SEQ ID NO: 1590 - DNA, 16 bp, Artificial sequence
  Synthetic oligonucleotide
cattggaggagggttg

SEQ ID NO: 1591 - DNA, 16 bp, Artificial sequence
  Synthetic oligonucleotide
gtttgtgaagcatcct

SEQ ID NO: 1592 - DNA, 16 bp, Artificial sequence
  Synthetic oligonucleotide
gatgtataccaacgac

SEQ ID NO: 1593 - DNA, 16 bp, Artificial sequence
  Synthetic oligonucleotide
atgatattagagactg

SEQ ID NO: 1594 - DNA, 16 bp, Artificial sequence
  Synthetic oligonucleotide
agcccttacctcgccc

SEQ ID NO: 1595 - DNA, 16 bp, Artificial sequence
  Synthetic oligonucleotide
ggccgccgtgagcttg

SEQ ID NO: 1596 - DNA, 16 bp, Artificial sequence
  Synthetic oligonucleotide
ccgcgaaggctcctac

SEQ ID NO: 1597 - DNA, 16 bp, Artificial sequence
  Synthetic oligonucleotide
cacggacggaggcggc

SEQ ID NO: 1598 - DNA, 16 bp, Artificial sequence
  Synthetic oligonucleotide
ggagtacccgcagaga

SEQ ID NO: 1599 - DNA, 16 bp, Artificial sequence
  Synthetic oligonucleotide
aaccggtagagtgaga

SEQ ID NO: 1600 - DNA, 16 bp, Artificial sequence
  Synthetic oligonucleotide
cgcagcatcgaactcc

SEQ ID NO: 1601 - DNA, 16 bp, Artificial sequence
  Synthetic oligonucleotide
cattgaggcatacagt

SEQ ID NO: 1602 - DNA, 16 bp, Artificial sequence
  Synthetic oligonucleotide
ataaacacctcagctg

SEQ ID NO: 1603 - DNA, 16 bp, Artificial sequence
  Synthetic oligonucleotide
aggaactgacctaact

SEQ ID NO: 1604 - DNA, 16 bp, Artificial sequence
  Synthetic oligonucleotide
tgataaggcactactt

SEQ ID NO: 1605 - DNA, 16 bp, Artificial sequence
  Synthetic oligonucleotide
gcattttatcatccga

SEQ ID NO: 1606 - DNA, 16 bp, Artificial sequence
  Synthetic oligonucleotide
aggaagcactggcatt

SEQ ID NO: 1607 - DNA, 16 bp, Artificial sequence
  Synthetic oligonucleotide
cacgaagggcagtgcc

SEQ ID NO: 1608 - DNA, 16 bp, Artificial sequence
  Synthetic oligonucleotide
atctaatccacaatca

SEQ ID NO: 1609 - DNA, 16 bp, Artificial sequence
  Synthetic oligonucleotide
cattaaagagtggtac

SEQ ID NO: 1610 - DNA, 16 bp, Artificial sequence
  Synthetic oligonucleotide
actaattccatagagc

SEQ ID NO: 1611 - DNA, 16 bp, Artificial sequence
  Synthetic oligonucleotide
tgacatgctttgtcct

SEQ ID NO: 1612 - DNA, 16 bp, Artificial sequence
  Synthetic oligonucleotide
atcagatgatgtctag

SEQ ID NO: 1613 - DNA, 16 bp, Artificial sequence
  Synthetic oligonucleotide
ctccattcaagccagt

SEQ ID NO: 1614 - DNA, 16 bp, Artificial sequence
  Synthetic oligonucleotide
gcaagctatattaaag

SEQ ID NO: 1615 - DNA, 16 bp, Artificial sequence
  Synthetic oligonucleotide
caaaagtgccacaact

SEQ ID NO: 1616 - DNA, 16 bp, Artificial sequence
  Synthetic oligonucleotide
atcagaaatcacgagg

SEQ ID NO: 1617 - DNA, 16 bp, Artificial sequence
  Synthetic oligonucleotide
atcaatgggaatcaca

SEQ ID NO: 1618 - DNA, 16 bp, Artificial sequence
  Synthetic oligonucleotide
acacacattaaagggt

SEQ ID NO: 1619 - DNA, 16 bp, Artificial sequence
  Synthetic oligonucleotide
agcatcactattaaga

SEQ ID NO: 1620 - DNA, 16 bp, Artificial sequence
  Synthetic oligonucleotide
tggaactctagtgtcc

SEQ ID NO: 1621 - DNA, 16 bp, Artificial sequence
  Synthetic oligonucleotide
accagaattgcaagag

SEQ ID NO: 1622 - DNA, 16 bp, Artificial sequence
  Synthetic oligonucleotide
gtgcaaaaccagtaca

SEQ ID NO: 1623 - DNA, 16 bp, Artificial sequence
  Synthetic oligonucleotide
gagcacatgtcaacag

SEQ ID NO: 1624 - DNA, 16 bp, Artificial sequence
  Synthetic oligonucleotide
tcacttgccgccgcct

SEQ ID NO: 1625 - DNA, 16 bp, Artificial sequence
  Synthetic oligonucleotide
gttctagtcgcgcaag

SEQ ID NO: 1626 - DNA, 16 bp, Artificial sequence
  Synthetic oligonucleotide
aatcagaatggcgagt

SEQ ID NO: 1627 - DNA, 16 bp, Artificial sequence
  Synthetic oligonucleotide
gtgcagacctgaatag

SEQ ID NO: 1628 - DNA, 16 bp, Artificial sequence
  Synthetic oligonucleotide
ctggaacattgttgga

SEQ ID NO: 1629 - DNA, 16 bp, Artificial sequence
  Synthetic oligonucleotide
cagaaaatatgtaacg

SEQ ID NO: 1630 - DNA, 16 bp, Artificial sequence
  Synthetic oligonucleotide
cattggacccacgaag

SEQ ID NO: 1631 - DNA, 16 bp, Artificial sequence
  Synthetic oligonucleotide
gttcagaaaccctcat

SEQ ID NO: 1632 - DNA, 16 bp, Artificial sequence
  Synthetic oligonucleotide
gaaagaggcaccctcc

SEQ ID NO: 1633 - DNA, 16 bp, Artificial sequence
  Synthetic oligonucleotide
taaaagaggtgctagg

SEQ ID NO: 1634 - DNA, 16 bp, Artificial sequence
  Synthetic oligonucleotide
gtatgtagcaatgtga

SEQ ID NO: 1635 - DNA, 16 bp, Artificial sequence
  Synthetic oligonucleotide
ctggagagaactcatg

SEQ ID NO: 1636 - DNA, 16 bp, Artificial sequence
  Synthetic oligonucleotide
attttatggaccacgc

SEQ ID NO: 1637 - DNA, 16 bp, Artificial sequence
  Synthetic oligonucleotide
ccacaactgcagtttg

SEQ ID NO: 1638 - DNA, 16 bp, Artificial sequence
  Synthetic oligonucleotide
agcccaaagttacatc

SEQ ID NO: 1639 - DNA, 16 bp, Artificial sequence
  Synthetic oligonucleotide
cactaagtgggctctg

SEQ ID NO: 1640 - DNA, 16 bp, Artificial sequence
  Synthetic oligonucleotide
ccgaactctccgcctc

SEQ ID NO: 1641 - DNA, 16 bp, Artificial sequence
  Synthetic oligonucleotide
ataaaaggttcctgtc

SEQ ID NO: 1642 - DNA, 16 bp, Artificial sequence
  Synthetic oligonucleotide
tggaatcttggcaggg

SEQ ID NO: 1643 - DNA, 16 bp, Artificial sequence
  Synthetic oligonucleotide
atagaggaatggcgga

SEQ ID NO: 1644 - DNA, 16 bp, Artificial sequence
  Synthetic oligonucleotide
aatcagatgtcactga

SEQ ID NO: 1645 - DNA, 16 bp, Artificial sequence
  Synthetic oligonucleotide
cctaatctacaacaaa

SEQ ID NO: 1646 - DNA, 16 bp, Artificial sequence
  Synthetic oligonucleotide
cctacatacattaata

SEQ ID NO: 1647 - DNA, 16 bp, Artificial sequence
  Synthetic oligonucleotide
tactaactggcttcca

SEQ ID NO: 1648 - DNA, 16 bp, Artificial sequence
  Synthetic oligonucleotide
aaccattacttagaca

SEQ ID NO: 1649 - DNA, 16 bp, Artificial sequence
  Synthetic oligonucleotide
cagatagttaagtact

SEQ ID NO: 1650 - DNA, 16 bp, Artificial sequence
  Synthetic oligonucleotide
tgtcaaactataattg

SEQ ID NO: 1651 - DNA, 16 bp, Artificial sequence
  Synthetic oligonucleotide
taggtatacttaagca

SEQ ID NO: 1652 - DNA, 16 bp, Artificial sequence
  Synthetic oligonucleotide
gtaatagtaaatatcc

SEQ ID NO: 1653 - DNA, 16 bp, Artificial sequence
  Synthetic oligonucleotide
cactaagcttgataaa

SEQ ID NO: 1654 - DNA, 16 bp, Artificial sequence
  Synthetic oligonucleotide
tgttagctacaaagag

SEQ ID NO: 1655 - DNA, 16 bp, Artificial sequence
  Synthetic oligonucleotide
tgaaatgtcaaaccct

SEQ ID NO: 1656 - DNA, 16 bp, Artificial sequence
  Synthetic oligonucleotide
ggataatataccccaa

SEQ ID NO: 1657 - DNA, 16 bp, Artificial sequence
  Synthetic oligonucleotide
attgaaatggagcatc

SEQ ID NO: 1658 - DNA, 16 bp, Artificial sequence
  Synthetic oligonucleotide
aggagatattaattac

SEQ ID NO: 1659 - DNA, 16 bp, Artificial sequence
  Synthetic oligonucleotide
gtaagggctgctcatt

SEQ ID NO: 1660 - DNA, 16 bp, Artificial sequence
  Synthetic oligonucleotide
ggctagctgtatttat

SEQ ID NO: 1661 - DNA, 16 bp, Artificial sequence
  Synthetic oligonucleotide
ttacactggatctgaa

SEQ ID NO: 1662 - DNA, 16 bp, Artificial sequence
  Synthetic oligonucleotide
tgtaaggtctgagagc

SEQ ID NO: 1663 - DNA, 16 bp, Artificial sequence
  Synthetic oligonucleotide
tccattggaggagggt

SEQ ID NO: 1664 - DNA, 16 bp, Artificial sequence
  Synthetic oligonucleotide
agtttgtgaagcatcc

SEQ ID NO: 1665 - DNA, 16 bp, Artificial sequence
  Synthetic oligonucleotide
atgatgtataccaacg

SEQ ID NO: 1666 - DNA, 16 bp, Artificial sequence
  Synthetic oligonucleotide
catgatattagagact

SEQ ID NO: 1667 - DNA, 16 bp, Artificial sequence
  Synthetic oligonucleotide
ctggttcgcgctccgg

SEQ ID NO: 1668 - DNA, 16 bp, Artificial sequence
  Synthetic oligonucleotide
ccggaggccgccgtga

SEQ ID NO: 1669 - DNA, 16 bp, Artificial sequence
  Synthetic oligonucleotide
cgcactaagtgggctc

SEQ ID NO: 1670 - DNA, 16 bp, Artificial sequence
  Synthetic oligonucleotide
gcacagccgtccgcct

SEQ ID NO: 1671 - DNA, 16 bp, Artificial sequence
  Synthetic oligonucleotide
cgccacctgatgcctc

SEQ ID NO: 1672 - DNA, 16 bp, Artificial sequence
  Synthetic oligonucleotide
cccacggacggaggcg

SEQ ID NO: 1673 - DNA, 16 bp, Artificial sequence
  Synthetic oligonucleotide
tgggagtacccgcaga

SEQ ID NO: 1674 - DNA, 16 bp, Artificial sequence
  Synthetic oligonucleotide
ataaccggtagagtga

SEQ ID NO: 1675 - DNA, 16 bp, Artificial sequence
  Synthetic oligonucleotide
ccgcagcatcgaactc

SEQ ID NO: 1676 - DNA, 16 bp, Artificial sequence
  Synthetic oligonucleotide
ggtcagaatcttgaaa

SEQ ID NO: 1677 - DNA, 16 bp, Artificial sequence
  Synthetic oligonucleotide
aaacaggaactgacct

SEQ ID NO: 1678 - DNA, 16 bp, Artificial sequence
  Synthetic oligonucleotide
atgataaggcactact

SEQ ID NO: 1679 - DNA, 16 bp, Artificial sequence
  Synthetic oligonucleotide
agcattttatcatccg

SEQ ID NO: 1680 - DNA, 16 bp, Artificial sequence
  Synthetic oligonucleotide
ttaaaggagtgcagga

SEQ ID NO: 1681 - DNA, 16 bp, Artificial sequence
  Synthetic oligonucleotide
cccacgaagggcagtg

SEQ ID NO: 1682 - DNA, 16 bp, Artificial sequence
  Synthetic oligonucleotide
ccacatctaatccaca

SEQ ID NO: 1683 - DNA, 16 bp, Artificial sequence
  Synthetic oligonucleotide
gtgaacatgccactca

SEQ ID NO: 1684 - DNA, 16 bp, Artificial sequence
  Synthetic oligonucleotide
tactaattccatagag

SEQ ID NO: 1685 - DNA, 16 bp, Artificial sequence
  Synthetic oligonucleotide
atgacatgctttgtcc

SEQ ID NO: 1686 - DNA, 16 bp, Artificial sequence
  Synthetic oligonucleotide
agcaaaccctgcactc

SEQ ID NO: 1687 - DNA, 16 bp, Artificial sequence
  Synthetic oligonucleotide
ggtaaaggcacattcc

SEQ ID NO: 1688 - DNA, 16 bp, Artificial sequence
  Synthetic oligonucleotide
ttgcaagctatattaa

SEQ ID NO: 1689 - DNA, 16 bp, Artificial sequence
  Synthetic oligonucleotide
tggtaggtcaaactcc

SEQ ID NO: 1690 - DNA, 16 bp, Artificial sequence
  Synthetic oligonucleotide
catcagaaatcacgag

SEQ ID NO: 1691 - DNA, 16 bp, Artificial sequence
  Synthetic oligonucleotide
ggtaactgtatggaac

SEQ ID NO: 1692 - DNA, 16 bp, Artificial sequence
  Synthetic oligonucleotide
gaattaggtgcttaat

SEQ ID NO: 1693 - DNA, 16 bp, Artificial sequence
  Synthetic oligonucleotide
tatagagcatcactat

SEQ ID NO: 1694 - DNA, 16 bp, Artificial sequence
  Synthetic oligonucleotide
gtggaactctagtgtc

SEQ ID NO: 1695 - DNA, 16 bp, Artificial sequence
  Synthetic oligonucleotide
taagaggcgactgctg

SEQ ID NO: 1696 - DNA, 16 bp, Artificial sequence
  Synthetic oligonucleotide
ctcctataacttctcc

SEQ ID NO: 1697 - DNA, 16 bp, Artificial sequence
  Synthetic oligonucleotide
tacgagcacatgtcaa

SEQ ID NO: 1698 - DNA, 16 bp, Artificial sequence
  Synthetic oligonucleotide
tagaatgagaggtgtc

SEQ ID NO: 1699 - DNA, 16 bp, Artificial sequence
  Synthetic oligonucleotide
taatagtaagttctag

SEQ ID NO: 1700 - DNA, 16 bp, Artificial sequence
  Synthetic oligonucleotide
aggctaatcagaatgg

SEQ ID NO: 1701 - DNA, 16 bp, Artificial sequence
  Synthetic oligonucleotide
tcagatacacaccctc

SEQ ID NO: 1702 - DNA, 16 bp, Artificial sequence
  Synthetic oligonucleotide
aaacggactggaacat

SEQ ID NO: 1703 - DNA, 16 bp, Artificial sequence
  Synthetic oligonucleotide
gtaactcaggcaccac

SEQ ID NO: 1704 - DNA, 16 bp, Artificial sequence
  Synthetic oligonucleotide
gctaaagaacactgct

SEQ ID NO: 1705 - DNA, 16 bp, Artificial sequence
  Synthetic oligonucleotide
gaccatgttcagaaac

SEQ ID NO: 1706 - DNA, 16 bp, Artificial sequence
  Synthetic oligonucleotide
ggaaagaggcaccctc

SEQ ID NO: 1707 - DNA, 16 bp, Artificial sequence
  Synthetic oligonucleotide
tatcatatgcccaata

SEQ ID NO: 1708 - DNA, 16 bp, Artificial sequence
  Synthetic oligonucleotide
tgcaagtatgtagcaa

SEQ ID NO: 1709 - DNA, 16 bp, Artificial sequence
  Synthetic oligonucleotide
aatcactggagagaac

SEQ ID NO: 1710 - DNA, 16 bp, Artificial sequence
  Synthetic oligonucleotide
cattttatggaccacg

SEQ ID NO: 1711 - DNA, 16 bp, Artificial sequence
  Synthetic oligonucleotide
ggccaatgattttgtt

SEQ ID NO: 1712 - DNA, 16 bp, Artificial sequence
  Synthetic oligonucleotide
gtaaagcccaaagtta

SEQ ID NO: 1713 - DNA, 16 bp, Artificial sequence
  Synthetic oligonucleotide
tgccgaactctccgcc

SEQ ID NO: 1714 - DNA, 16 bp, Artificial sequence
  Synthetic oligonucleotide
actttgtacgggtctg

SEQ ID NO: 1715 - DNA, 16 bp, Artificial sequence
  Synthetic oligonucleotide
aagcataaaaggttcc

SEQ ID NO: 1716 - DNA, 16 bp, Artificial sequence
  Synthetic oligonucleotide
gaccacgcccctctcc

SEQ ID NO: 1717 - DNA, 16 bp, Artificial sequence
  Synthetic oligonucleotide
agtcacctggaatctt

SEQ ID NO: 1718 - DNA, 16 bp, Artificial sequence
  Synthetic oligonucleotide
aatagaggaatggcgg

SEQ ID NO: 1719 - DNA, 16 bp, Artificial sequence
  Synthetic oligonucleotide
gccaatcagatgtcac

SEQ ID NO: 1720 - DNA, 16 bp, Artificial sequence
  Synthetic oligonucleotide
acctaatctacaacaa

SEQ ID NO: 1721 - DNA, 16 bp, Artificial sequence
  Synthetic oligonucleotide
agctcctacatacatt

SEQ ID NO: 1722 - DNA, 16 bp, Artificial sequence
  Synthetic oligonucleotide
tttactaactggcttc

SEQ ID NO: 1723 - DNA, 16 bp, Artificial sequence
  Synthetic oligonucleotide
ggtcaaaaagatgcag

SEQ ID NO: 1724 - DNA, 16 bp, Artificial sequence
  Synthetic oligonucleotide
acagatagttaagtac

SEQ ID NO: 1725 - DNA, 16 bp, Artificial sequence
  Synthetic oligonucleotide
tttaaggccctgtcaa

SEQ ID NO: 1726 - DNA, 16 bp, Artificial sequence
  Synthetic oligonucleotide
gataggtatacttaag

SEQ ID NO: 1727 - DNA, 16 bp, Artificial sequence
  Synthetic oligonucleotide
tgggagtaatagtaaa

SEQ ID NO: 1728 - DNA, 16 bp, Artificial sequence
  Synthetic oligonucleotide
tcactaagcttgataa

SEQ ID NO: 1729 - DNA, 16 bp, Artificial sequence
  Synthetic oligonucleotide
cttcactgttagctac

SEQ ID NO: 1730 - DNA, 16 bp, Artificial sequence
  Synthetic oligonucleotide
ttgcatggctaatgaa

SEQ ID NO: 1731 - DNA, 16 bp, Artificial sequence
  Synthetic oligonucleotide
aggataatatacccca

SEQ ID NO: 1732 - DNA, 16 bp, Artificial sequence
  Synthetic oligonucleotide
caattgaaatggagca

SEQ ID NO: 1733 - DNA, 16 bp, Artificial sequence
  Synthetic oligonucleotide
cctgagacaagtgcta

SEQ ID NO: 1734 - DNA, 16 bp, Artificial sequence
  Synthetic oligonucleotide
tctatagtgttccagg

SEQ ID NO: 1735 - DNA, 16 bp, Artificial sequence
  Synthetic oligonucleotide
ctgtaagggctgctca

SEQ ID NO: 1736 - DNA, 16 bp, Artificial sequence
  Synthetic oligonucleotide
tcccagagttgttcca

SEQ ID NO: 1737 - DNA, 16 bp, Artificial sequence
  Synthetic oligonucleotide
tttacactggatctga

SEQ ID NO: 1738 - DNA, 16 bp, Artificial sequence
  Synthetic oligonucleotide
gtgtaaggtctgagag

SEQ ID NO: 1739 - DNA, 16 bp, Artificial sequence
  Synthetic oligonucleotide
ttccattggaggaggg

SEQ ID NO: 1740 - DNA, 16 bp, Artificial sequence
  Synthetic oligonucleotide
cagtttgtgaagcatc

SEQ ID NO: 1741 - DNA, 16 bp, Artificial sequence
  Synthetic oligonucleotide
catgatgtataccaac

SEQ ID NO: 1742 - DNA, 16 bp, Artificial sequence
  Synthetic oligonucleotide
tcatgatattagagac

SEQ ID NO: 1743 - DNA, 16 bp, Artificial sequence
  Synthetic oligonucleotide
gtcgaacctctggttc

SEQ ID NO: 1744 - DNA, 16 bp, Artificial sequence
  Synthetic oligonucleotide
cgccggaggccgccgt

SEQ ID NO: 1745 - DNA, 16 bp, Artificial sequence
  Synthetic oligonucleotide
gcgcactaagtgggct

SEQ ID NO: 1746 - DNA, 16 bp, Artificial sequence
  Synthetic oligonucleotide
ggcacagccgtccgcc

SEQ ID NO: 1747 - DNA, 16 bp, Artificial sequence
  Synthetic oligonucleotide
ctgagagccgaggcct

SEQ ID NO: 1748 - DNA, 16 bp, Artificial sequence
  Synthetic oligonucleotide
acccacggacggaggc

SEQ ID NO: 1749 - DNA, 16 bp, Artificial sequence
  Synthetic oligonucleotide
acagaggtgggagtac

SEQ ID NO: 1750 - DNA, 16 bp, Artificial sequence
  Synthetic oligonucleotide
tataaccggtagagtg

SEQ ID NO: 1751 - DNA, 16 bp, Artificial sequence
  Synthetic oligonucleotide
acgatgatagctcacc

SEQ ID NO: 1752 - DNA, 16 bp, Artificial sequence
  Synthetic oligonucleotide
tacattgaggcataca

SEQ ID NO: 1753 - DNA, 16 bp, Artificial sequence
  Synthetic oligonucleotide
cccaagtgaggtcacc

SEQ ID NO: 1754 - DNA, 16 bp, Artificial sequence
  Synthetic oligonucleotide
ggctcctacatgtttg

SEQ ID NO: 1755 - DNA, 16 bp, Artificial sequence
  Synthetic oligonucleotide
acatgataaggcacta

SEQ ID NO: 1756 - DNA, 16 bp, Artificial sequence
  Synthetic oligonucleotide
gccgaagcattttatc

SEQ ID NO: 1757 - DNA, 16 bp, Artificial sequence
  Synthetic oligonucleotide
gttaaaggagtgcagg

SEQ ID NO: 1758 - DNA, 16 bp, Artificial sequence
  Synthetic oligonucleotide
tcccacgaagggcagt

SEQ ID NO: 1759 - DNA, 16 bp, Artificial sequence
  Synthetic oligonucleotide
tcattttgatgtctgg

SEQ ID NO: 1760 - DNA, 16 bp, Artificial sequence
  Synthetic oligonucleotide
gccaatgcaactgaat

SEQ ID NO: 1761 - DNA, 16 bp, Artificial sequence
  Synthetic oligonucleotide
gttactaattccatag

SEQ ID NO: 1762 - DNA, 16 bp, Artificial sequence
  Synthetic oligonucleotide
gacagatgacatgctt

SEQ ID NO: 1763 - DNA, 16 bp, Artificial sequence
  Synthetic oligonucleotide
gagcaaaccctgcact

SEQ ID NO: 1764 - DNA, 16 bp, Artificial sequence
  Synthetic oligonucleotide
aggtaaaggcacattc

SEQ ID NO: 1765 - DNA, 16 bp, Artificial sequence
  Synthetic oligonucleotide
tcagattgaatccata

SEQ ID NO: 1766 - DNA, 16 bp, Artificial sequence
  Synthetic oligonucleotide
agctggtaggtcaaac

SEQ ID NO: 1767 - DNA, 16 bp, Artificial sequence
  Synthetic oligonucleotide
ttcgaggtgattctcg

SEQ ID NO: 1768 - DNA, 16 bp, Artificial sequence
  Synthetic oligonucleotide
tggtaactgtatggaa

SEQ ID NO: 1769 - DNA, 16 bp, Artificial sequence
  Synthetic oligonucleotide
agaattaggtgcttaa

SEQ ID NO: 1770 - DNA, 16 bp, Artificial sequence
  Synthetic oligonucleotide
ctattatagagcatca

SEQ ID NO: 1771 - DNA, 16 bp, Artificial sequence
  Synthetic oligonucleotide
ggccaacgactccaca

SEQ ID NO: 1772 - DNA, 16 bp, Artificial sequence
  Synthetic oligonucleotide
ttaagaggcgactgct

SEQ ID NO: 1773 - DNA, 16 bp, Artificial sequence
  Synthetic oligonucleotide
cttatagcactctcct

SEQ ID NO: 1774 - DNA, 16 bp, Artificial sequence
  Synthetic oligonucleotide
agtacgagcacatgtc

SEQ ID NO: 1775 - DNA, 16 bp, Artificial sequence
  Synthetic oligonucleotide
aaggatgggaccgccc

SEQ ID NO: 1776 - DNA, 16 bp, Artificial sequence
  Synthetic oligonucleotide
agattaatagtaagtt

SEQ ID NO: 1777 - DNA, 16 bp, Artificial sequence
  Synthetic oligonucleotide
acacaggctaatcaga

SEQ ID NO: 1778 - DNA, 16 bp, Artificial sequence
  Synthetic oligonucleotide
atcagatacacaccct

SEQ ID NO: 1779 - DNA, 16 bp, Artificial sequence
  Synthetic oligonucleotide
caaaacggactggaac

SEQ ID NO: 1780 - DNA, 16 bp, Artificial sequence
  Synthetic oligonucleotide
cgtaactcaggcacca

SEQ ID NO: 1781 - DNA, 16 bp, Artificial sequence
  Synthetic oligonucleotide
gacagctaaagaacac

SEQ ID NO: 1782 - DNA, 16 bp, Artificial sequence
  Synthetic oligonucleotide
ccacaagaaagagacc

SEQ ID NO: 1783 - DNA, 16 bp, Artificial sequence
  Synthetic oligonucleotide
cgacaactttcctgaa

SEQ ID NO: 1784 - DNA, 16 bp, Artificial sequence
  Synthetic oligonucleotide
caaatatcatatgccc

SEQ ID NO: 1785 - DNA, 16 bp, Artificial sequence
  Synthetic oligonucleotide
taataatgcttgcaag

SEQ ID NO: 1786 - DNA, 16 bp, Artificial sequence
  Synthetic oligonucleotide
agtcaatcactggaga

SEQ ID NO: 1787 - DNA, 16 bp, Artificial sequence
  Synthetic oligonucleotide
attcattttatggacc

SEQ ID NO: 1788 - DNA, 16 bp, Artificial sequence
  Synthetic oligonucleotide
ggtaatttaggccaat

SEQ ID NO: 1789 - DNA, 16 bp, Artificial sequence
  Synthetic oligonucleotide
ctaaggagacagtaac

SEQ ID NO: 1790 - DNA, 16 bp, Artificial sequence
  Synthetic oligonucleotide
cgctcatgccgaactc

SEQ ID NO: 1791 - DNA, 16 bp, Artificial sequence
  Synthetic oligonucleotide
tacactttgtacgggt

SEQ ID NO: 1792 - DNA, 16 bp, Artificial sequence
  Synthetic oligonucleotide
gcacaagcataaaagg

SEQ ID NO: 1793 - DNA, 16 bp, Artificial sequence
  Synthetic oligonucleotide
gaggaccacgcccctc

SEQ ID NO: 1794 - DNA, 16 bp, Artificial sequence
  Synthetic oligonucleotide
gcatagagtcacctgg

SEQ ID NO: 1795 - DNA, 16 bp, Artificial sequence
  Synthetic oligonucleotide
gaatagaggaatggcg

SEQ ID NO: 1796 - DNA, 16 bp, Artificial sequence
  Synthetic oligonucleotide
tgccaatcagatgtca

SEQ ID NO: 1797 - DNA, 16 bp, Artificial sequence
  Synthetic oligonucleotide
gacctaatctacaaca

SEQ ID NO: 1798 - DNA, 16 bp, Artificial sequence
  Synthetic oligonucleotide
aagtgtcttccacaag

SEQ ID NO: 1799 - DNA, 16 bp, Artificial sequence
  Synthetic oligonucleotide
gtttactaactggctt

SEQ ID NO: 1800 - DNA, 16 bp, Artificial sequence
  Synthetic oligonucleotide
taaagaatgagggtca

SEQ ID NO: 1801 - DNA, 16 bp, Artificial sequence
  Synthetic oligonucleotide
gaacagatagttaagt

SEQ ID NO: 1802 - DNA, 16 bp, Artificial sequence
  Synthetic oligonucleotide
ttttaaggccctgtca

SEQ ID NO: 1803 - DNA, 16 bp, Artificial sequence
  Synthetic oligonucleotide
tgataggtatacttaa

SEQ ID NO: 1804 - DNA, 16 bp, Artificial sequence
  Synthetic oligonucleotide
cgcaatcttctgctga

SEQ ID NO: 1805 - DNA, 16 bp, Artificial sequence
  Synthetic oligonucleotide
gctcactaagcttgat

SEQ ID NO: 1806 - DNA, 16 bp, Artificial sequence
  Synthetic oligonucleotide
ggtaaatcttcactgt

SEQ ID NO: 1807 - DNA, 16 bp, Artificial sequence
  Synthetic oligonucleotide
atccatgttgcatggc

SEQ ID NO: 1808 - DNA, 16 bp, Artificial sequence
  Synthetic oligonucleotide
taggataatatacccc

SEQ ID NO: 1809 - DNA, 16 bp, Artificial sequence
  Synthetic oligonucleotide
gcaattgaaatggagc

SEQ ID NO: 1810 - DNA, 16 bp, Artificial sequence
  Synthetic oligonucleotide
aggaagccgttccttt

SEQ ID NO: 1811 - DNA, 16 bp, Artificial sequence
  Synthetic oligonucleotide
ctctatagtgttccag

SEQ ID NO: 1812 - DNA, 16 bp, Artificial sequence
  Synthetic oligonucleotide
actgtaagggctgctc

SEQ ID NO: 1813 - DNA, 16 bp, Artificial sequence
  Synthetic oligonucleotide
gagtacccaagactcc

SEQ ID NO: 1814 - DNA, 16 bp, Artificial sequence
  Synthetic oligonucleotide
gtttacactggatctg

SEQ ID NO: 1815 - DNA, 16 bp, Artificial sequence
  Synthetic oligonucleotide
caaaatggtgtgtaag

SEQ ID NO: 1816 - DNA, 16 bp, Artificial sequence
  Synthetic oligonucleotide
gaatttccattggagg

SEQ ID NO: 1817 - DNA, 16 bp, Artificial sequence
  Synthetic oligonucleotide
ctcagtttgtgaagca

SEQ ID NO: 1818 - DNA, 16 bp, Artificial sequence
  Synthetic oligonucleotide
tcatgatgtataccaa

SEQ ID NO: 1819 - DNA, 16 bp, Artificial sequence
  Synthetic oligonucleotide
aatcatgatattagag

SEQ ID NO: 1820 - DNA, 16 bp, Artificial sequence
  Synthetic oligonucleotide
ctggaggtcgaacctc

SEQ ID NO: 1821 - DNA, 16 bp, Artificial sequence
  Synthetic oligonucleotide
ggtgagcaccgcgccg

SEQ ID NO: 1822 - DNA, 16 bp, Artificial sequence
  Synthetic oligonucleotide
gcccagctagcgcgca

SEQ ID NO: 1823 - DNA, 16 bp, Artificial sequence
  Synthetic oligonucleotide
gcgcatcccctgggcg

SEQ ID NO: 1824 - DNA, 16 bp, Artificial sequence
  Synthetic oligonucleotide
ccgctgagagccgagg

SEQ ID NO: 1825 - DNA, 16 bp, Artificial sequence
  Synthetic oligonucleotide
gggacccacggacgga

SEQ ID NO: 1826 - DNA, 16 bp, Artificial sequence
  Synthetic oligonucleotide
ctctagacagaggccc

SEQ ID NO: 1827 - DNA, 16 bp, Artificial sequence
  Synthetic oligonucleotide
ttataaccggtagagt

SEQ ID NO: 1828 - DNA, 16 bp, Artificial sequence
  Synthetic oligonucleotide
ggtttattagctttct

SEQ ID NO: 1829 - DNA, 16 bp, Artificial sequence
  Synthetic oligonucleotide
ccatatacattgaggc

SEQ ID NO: 1830 - DNA, 16 bp, Artificial sequence
  Synthetic oligonucleotide
ataaaggaccccgcca

SEQ ID NO: 1831 - DNA, 16 bp, Artificial sequence
  Synthetic oligonucleotide
ggcaagttctgctgtc

SEQ ID NO: 1832 - DNA, 16 bp, Artificial sequence
  Synthetic oligonucleotide
tttcacatgataaggc

SEQ ID NO: 1833 - DNA, 16 bp, Artificial sequence
  Synthetic oligonucleotide
agccgaagcattttat

SEQ ID NO: 1834 - DNA, 16 bp, Artificial sequence
  Synthetic oligonucleotide
ctaaaggagtgcagga

SEQ ID NO: 1835 - DNA, 16 bp, Artificial sequence
  Synthetic oligonucleotide
ataagatcccacgaag

SEQ ID NO: 1836 - DNA, 16 bp, Artificial sequence
  Synthetic oligonucleotide
agctaatgagagcttc

SEQ ID NO: 1837 - DNA, 16 bp, Artificial sequence
  Synthetic oligonucleotide
cttgaaaagccaatgc

SEQ ID NO: 1838 - DNA, 16 bp, Artificial sequence
  Synthetic oligonucleotide
ggttactaattccata

SEQ ID NO: 1839 - DNA, 16 bp, Artificial sequence
  Synthetic oligonucleotide
agacagatgacatgct

SEQ ID NO: 1840 - DNA, 16 bp, Artificial sequence
  Synthetic oligonucleotide
tctaaagtcccatcga

SEQ ID NO: 1841 - DNA, 16 bp, Artificial sequence
  Synthetic oligonucleotide
gtaaaggtaaaggcac

SEQ ID NO: 1842 - DNA, 16 bp, Artificial sequence
  Synthetic oligonucleotide
ggtaagatctccatgg

SEQ ID NO: 1843 - DNA, 16 bp, Artificial sequence
  Synthetic oligonucleotide
gaaagagctggtaggt

SEQ ID NO: 1844 - DNA, 16 bp, Artificial sequence
  Synthetic oligonucleotide
gccattcgaggtgatt

SEQ ID NO: 1845 - DNA, 16 bp, Artificial sequence
  Synthetic oligonucleotide
accaagctgggtttgc

SEQ ID NO: 1846 - DNA, 16 bp, Artificial sequence
  Synthetic oligonucleotide
atagaattaggtgctt

SEQ ID NO: 1847 - DNA, 16 bp, Artificial sequence
  Synthetic oligonucleotide
cctattatagagcatc

SEQ ID NO: 1848 - DNA, 16 bp, Artificial sequence
  Synthetic oligonucleotide
ctcgaggccaacgact

SEQ ID NO: 1849 - DNA, 16 bp, Artificial sequence
  Synthetic oligonucleotide
gttttaagaggcgact

SEQ ID NO: 1850 - DNA, 16 bp, Artificial sequence
  Synthetic oligonucleotide
aacttatagcactctc

SEQ ID NO: 1851 - DNA, 16 bp, Artificial sequence
  Synthetic oligonucleotide
agaagtacgagcacat

SEQ ID NO: 1852 - DNA, 16 bp, Artificial sequence
  Synthetic oligonucleotide
gaaggatgggaccgcc

SEQ ID NO: 1853 - DNA, 16 bp, Artificial sequence
  Synthetic oligonucleotide
tcacagattaatagta

SEQ ID NO: 1854 - DNA, 16 bp, Artificial sequence
  Synthetic oligonucleotide
cctacacaggctaatc

SEQ ID NO: 1855 - DNA, 16 bp, Artificial sequence
  Synthetic oligonucleotide
tatcagatacacaccc

SEQ ID NO: 1856 - DNA, 16 bp, Artificial sequence
  Synthetic oligonucleotide
acaaaacggactggaa

SEQ ID NO: 1857 - DNA, 16 bp, Artificial sequence
  Synthetic oligonucleotide
tgctactgcggacatc

SEQ ID NO: 1858 - DNA, 16 bp, Artificial sequence
  Synthetic oligonucleotide
cgacagctaaagaaca

SEQ ID NO: 1859 - DNA, 16 bp, Artificial sequence
  Synthetic oligonucleotide
tagaagcccacaagaa

SEQ ID NO: 1860 - DNA, 16 bp, Artificial sequence
  Synthetic oligonucleotide
tacgacaactttcctg

SEQ ID NO: 1861 - DNA, 16 bp, Artificial sequence
  Synthetic oligonucleotide
gaaagattcagcctct

SEQ ID NO: 1862 - DNA, 16 bp, Artificial sequence
  Synthetic oligonucleotide
gttaataatgcttgca

SEQ ID NO: 1863 - DNA, 16 bp, Artificial sequence
  Synthetic oligonucleotide
ttattaagtcaatcac

SEQ ID NO: 1864 - DNA, 16 bp, Artificial sequence
  Synthetic oligonucleotide
ctcataggtgtacacg

SEQ ID NO: 1865 - DNA, 16 bp, Artificial sequence
  Synthetic oligonucleotide
ctgcagggtaatttag

SEQ ID NO: 1866 - DNA, 16 bp, Artificial sequence
  Synthetic oligonucleotide
cagcactcagattcta

SEQ ID NO: 1867 - DNA, 16 bp, Artificial sequence
  Synthetic oligonucleotide
ggcacaagcataaaag

SEQ ID NO: 1868 - DNA, 16 bp, Artificial sequence
  Synthetic oligonucleotide
aaatgagtcggtcact

SEQ ID NO: 1869 - DNA, 16 bp, Artificial sequence
  Synthetic oligonucleotide
gctcaccgcgctcatg

SEQ ID NO: 1870 - DNA, 16 bp, Artificial sequence
  Synthetic oligonucleotide
gtacactttgtacggg

SEQ ID NO: 1871 - DNA, 16 bp, Artificial sequence
  Synthetic oligonucleotide
atccagaggaccacgc

SEQ ID NO: 1872 - DNA, 16 bp, Artificial sequence
  Synthetic oligonucleotide
agcatagagtcacctg

SEQ ID NO: 1873 - DNA, 16 bp, Artificial sequence
  Synthetic oligonucleotide
tgaatagaggaatggc

SEQ ID NO: 1874 - DNA, 16 bp, Artificial sequence
  Synthetic oligonucleotide
aataagctcatctgcc

SEQ ID NO: 1875 - DNA, 16 bp, Artificial sequence
  Synthetic oligonucleotide
caagacctaatctaca

SEQ ID NO: 1876 - DNA, 16 bp, Artificial sequence
  Synthetic oligonucleotide
caagtgtcttccacaa

SEQ ID NO: 1877 - DNA, 16 bp, Artificial sequence
  Synthetic oligonucleotide
agtttactaactggct

SEQ ID NO: 1878 - DNA, 16 bp, Artificial sequence
  Synthetic oligonucleotide
ctaaagaatgagggtc

SEQ ID NO: 1879 - DNA, 16 bp, Artificial sequence
  Synthetic oligonucleotide
gggaacagatagttaa

SEQ ID NO: 1880 - DNA, 16 bp, Artificial sequence
  Synthetic oligonucleotide
aattttaaggccctgt

SEQ ID NO: 1881 - DNA, 16 bp, Artificial sequence
  Synthetic oligonucleotide
gtgataggtatactta

SEQ ID NO: 1882 - DNA, 16 bp, Artificial sequence
  Synthetic oligonucleotide
acgcaatcttctgctg

SEQ ID NO: 1883 - DNA, 16 bp, Artificial sequence
  Synthetic oligonucleotide
gctcactgctcactaa

SEQ ID NO: 1884 - DNA, 16 bp, Artificial sequence
  Synthetic oligonucleotide
aggtaaatcttcactg

SEQ ID NO: 1885 - DNA, 16 bp, Artificial sequence
  Synthetic oligonucleotide
acatatccatgttgca

SEQ ID NO: 1886 - DNA, 16 bp, Artificial sequence
  Synthetic oligonucleotide
ttaggataatataccc

SEQ ID NO: 1887 - DNA, 16 bp, Artificial sequence
  Synthetic oligonucleotide
actgttaaagcagcat

SEQ ID NO: 1888 - DNA, 16 bp, Artificial sequence
  Synthetic oligonucleotide
gaggaagccgttcctt

SEQ ID NO: 1889 - DNA, 16 bp, Artificial sequence
  Synthetic oligonucleotide
atactgtaagggctgc

SEQ ID NO: 1890 - DNA, 16 bp, Artificial sequence
  Synthetic oligonucleotide
aagaggtgcgagtacc

SEQ ID NO: 1891 - DNA, 16 bp, Artificial sequence
  Synthetic oligonucleotide
aagtttacactggatc

SEQ ID NO: 1892 - DNA, 16 bp, Artificial sequence
  Synthetic oligonucleotide
gggcatgtaaaacata

SEQ ID NO: 1893 - DNA, 16 bp, Artificial sequence
  Synthetic oligonucleotide
gggaatttccattgga

SEQ ID NO: 1894 - DNA, 16 bp, Artificial sequence
  Synthetic oligonucleotide
cctcagtttgtgaagc

SEQ ID NO: 1895 - DNA, 16 bp, Artificial sequence
  Synthetic oligonucleotide
attcatgatgtatacc

SEQ ID NO: 1896 - DNA, 16 bp, Artificial sequence
  Synthetic oligonucleotide
caatcatgatattaga

SEQ ID NO: 1897 - DNA, 16 bp, Artificial sequence
  Synthetic oligonucleotide
gggtaccctgcgctgc

SEQ ID NO: 1898 - DNA, 16 bp, Artificial sequence
  Synthetic oligonucleotide
ccaaatgtggagctcc

SEQ ID NO: 1899 - DNA, 16 bp, Artificial sequence
  Synthetic oligonucleotide
cgaataggacccctat

SEQ ID NO: 1900 - DNA, 16 bp, Artificial sequence
  Synthetic oligonucleotide
ggcccgggcgcatccc

SEQ ID NO: 1901 - DNA, 16 bp, Artificial sequence
  Synthetic oligonucleotide
ccccgcggtcccgctg

SEQ ID NO: 1902 - DNA, 16 bp, Artificial sequence
  Synthetic oligonucleotide
acgcacggagagggcg

SEQ ID NO: 1903 - DNA, 16 bp, Artificial sequence
  Synthetic oligonucleotide
agctctagacagaggc

SEQ ID NO: 1904 - DNA, 16 bp, Artificial sequence
  Synthetic oligonucleotide
tttataaccggtagag

SEQ ID NO: 1905 - DNA, 16 bp, Artificial sequence
  Synthetic oligonucleotide
cgaaaagtcaaaatac

SEQ ID NO: 1906 - DNA, 16 bp, Artificial sequence
  Synthetic oligonucleotide
ccccatatacattgag

SEQ ID NO: 1907 - DNA, 16 bp, Artificial sequence
  Synthetic oligonucleotide
acataaaggaccccgc

SEQ ID NO: 1908 - DNA, 16 bp, Artificial sequence
  Synthetic oligonucleotide
tagcaaatggcaagtt

SEQ ID NO: 1909 - DNA, 16 bp, Artificial sequence
  Synthetic oligonucleotide
gaagagatcagctgcc

SEQ ID NO: 1910 - DNA, 16 bp, Artificial sequence
  Synthetic oligonucleotide
tgacagccgaagcatt

SEQ ID NO: 1911 - DNA, 16 bp, Artificial sequence
  Synthetic oligonucleotide
gctaaaggagtgcagg

SEQ ID NO: 1912 - DNA, 16 bp, Artificial sequence
  Synthetic oligonucleotide
aataagatcccacgaa

SEQ ID NO: 1913 - DNA, 16 bp, Artificial sequence
  Synthetic oligonucleotide
acccagctaatgagag

SEQ ID NO: 1914 - DNA, 16 bp, Artificial sequence
  Synthetic oligonucleotide
ctgcaaatccctcttg

SEQ ID NO: 1915 - DNA, 16 bp, Artificial sequence
  Synthetic oligonucleotide
cagttctaagcattgc

SEQ ID NO: 1916 - DNA, 16 bp, Artificial sequence
  Synthetic oligonucleotide
gactaacagggagact

SEQ ID NO: 1917 - DNA, 16 bp, Artificial sequence
  Synthetic oligonucleotide
gtctaaagtcccatcg

SEQ ID NO: 1918 - DNA, 16 bp, Artificial sequence
  Synthetic oligonucleotide
cgtgagaatgttggct

SEQ ID NO: 1919 - DNA, 16 bp, Artificial sequence
  Synthetic oligonucleotide
tagtaggtaagatctc

SEQ ID NO: 1920 - DNA, 16 bp, Artificial sequence
  Synthetic oligonucleotide
agaaagagctggtagg

SEQ ID NO: 1921 - DNA, 16 bp, Artificial sequence
  Synthetic oligonucleotide
cccaaagagagtgggt

SEQ ID NO: 1922 - DNA, 16 bp, Artificial sequence
  Synthetic oligonucleotide
gttgaaagaaccaagc

SEQ ID NO: 1923 - DNA, 16 bp, Artificial sequence
  Synthetic oligonucleotide
tatagaattaggtgct

SEQ ID NO: 1924 - DNA, 16 bp, Artificial sequence
  Synthetic oligonucleotide
ggaacaagtgtatctt

SEQ ID NO: 1925 - DNA, 16 bp, Artificial sequence
  Synthetic oligonucleotide
caccacctcgaggcca

SEQ ID NO: 1926 - DNA, 16 bp, Artificial sequence
  Synthetic oligonucleotide
ctgttttaagaggcga

SEQ ID NO: 1927 - DNA, 16 bp, Artificial sequence
  Synthetic oligonucleotide
agccaacttatagcac

SEQ ID NO: 1928 - DNA, 16 bp, Artificial sequence
  Synthetic oligonucleotide
cagaagtacgagcaca

SEQ ID NO: 1929 - DNA, 16 bp, Artificial sequence
  Synthetic oligonucleotide
caagaaggatgggacc

SEQ ID NO: 1930 - DNA, 16 bp, Artificial sequence
  Synthetic oligonucleotide
gctcacagattaatag

SEQ ID NO: 1931 - DNA, 16 bp, Artificial sequence
  Synthetic oligonucleotide
tacacctacacaggct

SEQ ID NO: 1932 - DNA, 16 bp, Artificial sequence
  Synthetic oligonucleotide
ctgcagaacagacgcg

SEQ ID NO: 1933 - DNA, 16 bp, Artificial sequence
  Synthetic oligonucleotide
tacaaaacggactgga

SEQ ID NO: 1934 - DNA, 16 bp, Artificial sequence
  Synthetic oligonucleotide
cataatccagtatctg

SEQ ID NO: 1935 - DNA, 16 bp, Artificial sequence
  Synthetic oligonucleotide
tagtcgacagctaaag

SEQ ID NO: 1936 - DNA, 16 bp, Artificial sequence
  Synthetic oligonucleotide
gtagaagcccacaaga

SEQ ID NO: 1937 - DNA, 16 bp, Artificial sequence
  Synthetic oligonucleotide
aatacgacaactttcc

SEQ ID NO: 1938 - DNA, 16 bp, Artificial sequence
  Synthetic oligonucleotide
ttgaaagattcagcct

SEQ ID NO: 1939 - DNA, 16 bp, Artificial sequence
  Synthetic oligonucleotide
gcatgcaagcccgtta

SEQ ID NO: 1940 - DNA, 16 bp, Artificial sequence
  Synthetic oligonucleotide
ttgttaacaatgtatc

SEQ ID NO: 1941 - DNA, 16 bp, Artificial sequence
  Synthetic oligonucleotide
actcataggtgtacac

SEQ ID NO: 1942 - DNA, 16 bp, Artificial sequence
  Synthetic oligonucleotide
gtctgagggaatctgc

SEQ ID NO: 1943 - DNA, 16 bp, Artificial sequence
  Synthetic oligonucleotide
ttaaacagcactcaga

SEQ ID NO: 1944 - DNA, 16 bp, Artificial sequence
  Synthetic oligonucleotide
gtaaatgagtcggtca

SEQ ID NO: 1945 - DNA, 16 bp, Artificial sequence
  Synthetic oligonucleotide
ccgcagctcaccgcgc

SEQ ID NO: 1946 - DNA, 16 bp, Artificial sequence
  Synthetic oligonucleotide
ctgtacactttgtacg

SEQ ID NO: 1947 - DNA, 16 bp, Artificial sequence
  Synthetic oligonucleotide
ggcagaccttatgctt

SEQ ID NO: 1948 - DNA, 16 bp, Artificial sequence
  Synthetic oligonucleotide
ggccatccagaggacc

SEQ ID NO: 1949 - DNA, 16 bp, Artificial sequence
  Synthetic oligonucleotide
aagcatagagtcacct

SEQ ID NO: 1950 - DNA, 16 bp, Artificial sequence
  Synthetic oligonucleotide
ttgaatagaggaatgg

SEQ ID NO: 1951 - DNA, 16 bp, Artificial sequence
  Synthetic oligonucleotide
gtctacagaacacaag

SEQ ID NO: 1952 - DNA, 16 bp, Artificial sequence
  Synthetic oligonucleotide
ttccagcaagacctaa

SEQ ID NO: 1953 - DNA, 16 bp, Artificial sequence
  Synthetic oligonucleotide
gcaagtgtcttccaca

SEQ ID NO: 1954 - DNA, 16 bp, Artificial sequence
  Synthetic oligonucleotide
aagtttactaactggc

SEQ ID NO: 1955 - DNA, 16 bp, Artificial sequence
  Synthetic oligonucleotide
cgaagaattttagcat

SEQ ID NO: 1956 - DNA, 16 bp, Artificial sequence
  Synthetic oligonucleotide
agggaacagatagtta

SEQ ID NO: 1957 - DNA, 16 bp, Artificial sequence
  Synthetic oligonucleotide
taattttaaggccctg

SEQ ID NO: 1958 - DNA, 16 bp, Artificial sequence
  Synthetic oligonucleotide
agtgataggtatactt

SEQ ID NO: 1959 - DNA, 16 bp, Artificial sequence
  Synthetic oligonucleotide
agctacgcaatcttct

SEQ ID NO: 1960 - DNA, 16 bp, Artificial sequence
  Synthetic oligonucleotide
acttttagagaggaga

SEQ ID NO: 1961 - DNA, 16 bp, Artificial sequence
  Synthetic oligonucleotide
acgaggtaaatcttca

SEQ ID NO: 1962 - DNA, 16 bp, Artificial sequence
  Synthetic oligonucleotide
tacatatccatgttgc

SEQ ID NO: 1963 - DNA, 16 bp, Artificial sequence
  Synthetic oligonucleotide
ccttaggataatatac

SEQ ID NO: 1964 - DNA, 16 bp, Artificial sequence
  Synthetic oligonucleotide
ccactgttaaagcagc

SEQ ID NO: 1965 - DNA, 16 bp, Artificial sequence
  Synthetic oligonucleotide
aatgaggaagccgttc

SEQ ID NO: 1966 - DNA, 16 bp, Artificial sequence
  Synthetic oligonucleotide
aatactgtaagggctg

SEQ ID NO: 1967 - DNA, 16 bp, Artificial sequence
  Synthetic oligonucleotide
ccaagaggtgcgagta

SEQ ID NO: 1968 - DNA, 16 bp, Artificial sequence
  Synthetic oligonucleotide
gaagtttacactggat

SEQ ID NO: 1969 - DNA, 16 bp, Artificial sequence
  Synthetic oligonucleotide
atcagtctcaaaaacg

SEQ ID NO: 1970 - DNA, 16 bp, Artificial sequence
  Synthetic oligonucleotide
acacgggaatttccat

SEQ ID NO: 1971 - DNA, 16 bp, Artificial sequence
  Synthetic oligonucleotide
acctcagtttgtgaag

SEQ ID NO: 1972 - DNA, 16 bp, Artificial sequence
  Synthetic oligonucleotide
ttgcagagcaatttac

SEQ ID NO: 1973 - DNA, 16 bp, Artificial sequence
  Synthetic oligonucleotide
catcaatcatgatatt

SEQ ID NO: 1974 - DNA, 16 bp, Artificial sequence
  Synthetic oligonucleotide
gctcggagcgacccaa

SEQ ID NO: 1975 - DNA, 16 bp, Artificial sequence
  Synthetic oligonucleotide
ccgaataggaccccta

SEQ ID NO: 1976 - DNA, 16 bp, Artificial sequence
  Synthetic oligonucleotide
ggccggcccgggcgca

SEQ ID NO: 1977 - DNA, 16 bp, Artificial sequence
  Synthetic oligonucleotide
caggacccggctcccg

SEQ ID NO: 1978 - DNA, 16 bp, Artificial sequence
  Synthetic oligonucleotide
cggacgcacggagagg

SEQ ID NO: 1979 - DNA, 16 bp, Artificial sequence
  Synthetic oligonucleotide
agggagacagctctag

SEQ ID NO: 1980 - DNA, 16 bp, Artificial sequence
  Synthetic oligonucleotide
gtatttataaccggta

SEQ ID NO: 1981 - DNA, 16 bp, Artificial sequence
  Synthetic oligonucleotide
caaattcaggagagcc

SEQ ID NO: 1982 - DNA, 16 bp, Artificial sequence
  Synthetic oligonucleotide
acatattcaatgcacc

SEQ ID NO: 1983 - DNA, 16 bp, Artificial sequence
  Synthetic oligonucleotide
tgacataaaggacccc

SEQ ID NO: 1984 - DNA, 16 bp, Artificial sequence
  Synthetic oligonucleotide
agccatagcaaatggc

SEQ ID NO: 1985 - DNA, 16 bp, Artificial sequence
  Synthetic oligonucleotide
cttttacccaccaaag

SEQ ID NO: 1986 - DNA, 16 bp, Artificial sequence
  Synthetic oligonucleotide
ttagactgacagccga

SEQ ID NO: 1987 - DNA, 16 bp, Artificial sequence
  Synthetic oligonucleotide
caattagctcttctat

SEQ ID NO: 1988 - DNA, 16 bp, Artificial sequence
  Synthetic oligonucleotide
ttaaataagatcccac

SEQ ID NO: 1989 - DNA, 16 bp, Artificial sequence
  Synthetic oligonucleotide
ctagattctccctgca

SEQ ID NO: 1990 - DNA, 16 bp, Artificial sequence
  Synthetic oligonucleotide
aaccagcccttgctgc

SEQ ID NO: 1991 - DNA, 16 bp, Artificial sequence
  Synthetic oligonucleotide
ctttacacagttctaa

SEQ ID NO: 1992 - DNA, 16 bp, Artificial sequence
  Synthetic oligonucleotide
actgactaacagggag

SEQ ID NO: 1993 - DNA, 16 bp, Artificial sequence
  Synthetic oligonucleotide
agcaagtgtctaaagt

SEQ ID NO: 1994 - DNA, 16 bp, Artificial sequence
  Synthetic oligonucleotide
tccaagcaattattcc

SEQ ID NO: 1995 - DNA, 16 bp, Artificial sequence
  Synthetic oligonucleotide
atagtaggtaagatct

SEQ ID NO: 1996 - DNA, 16 bp, Artificial sequence
  Synthetic oligonucleotide
tagaaagagctggtag

SEQ ID NO: 1997 - DNA, 16 bp, Artificial sequence
  Synthetic oligonucleotide
ccccaaagagagtggg

SEQ ID NO: 1998 - DNA, 16 bp, Artificial sequence
  Synthetic oligonucleotide
gcccatgagttgaaag

SEQ ID NO: 1999 - DNA, 16 bp, Artificial sequence
  Synthetic oligonucleotide
atatagaattaggtgc

SEQ ID NO: 2000 - DNA, 16 bp, Artificial sequence
  Synthetic oligonucleotide
aggaacaagtgtatct

SEQ ID NO: 2001 - DNA, 16 bp, Artificial sequence
  Synthetic oligonucleotide
acagagccaacttata

SEQ ID NO: 2002 - DNA, 16 bp, Artificial sequence
  Synthetic oligonucleotide
acccagaagtacgagc

SEQ ID NO: 2003 - DNA, 16 bp, Artificial sequence
  Synthetic oligonucleotide
cccatgaacaccatgc

SEQ ID NO: 2004 - DNA, 16 bp, Artificial sequence
  Synthetic oligonucleotide
gccaagaccagctctt

SEQ ID NO: 2005 - DNA, 16 bp, Artificial sequence
  Synthetic oligonucleotide
ctacacctacacaggc

SEQ ID NO: 2006 - DNA, 16 bp, Artificial sequence
  Synthetic oligonucleotide
cgctacagcttctgca

SEQ ID NO: 2007 - DNA, 16 bp, Artificial sequence
  Synthetic oligonucleotide
atacaaaacggactgg

SEQ ID NO: 2008 - DNA, 16 bp, Artificial sequence
  Synthetic oligonucleotide
cacataatccagtatc

SEQ ID NO: 2009 - DNA, 16 bp, Artificial sequence
  Synthetic oligonucleotide
aggaactagtcgacag

SEQ ID NO: 2010 - DNA, 16 bp, Artificial sequence
  Synthetic oligonucleotide
tgtaactgaggactca

SEQ ID NO: 2011 - DNA, 16 bp, Artificial sequence
  Synthetic oligonucleotide
aaatacgacaactttc

SEQ ID NO: 2012 - DNA, 16 bp, Artificial sequence
  Synthetic oligonucleotide
tgcttgaattccttga

SEQ ID NO: 2013 - DNA, 16 bp, Artificial sequence
  Synthetic oligonucleotide
gctcagcatgcaagcc

SEQ ID NO: 2014 - DNA, 16 bp, Artificial sequence
  Synthetic oligonucleotide
gcttatcaatgccaag

SEQ ID NO: 2015 - DNA, 16 bp, Artificial sequence
  Synthetic oligonucleotide
aactcataggtgtaca

SEQ ID NO: 2016 - DNA, 16 bp, Artificial sequence
  Synthetic oligonucleotide
tcaagtaaagtgatca

SEQ ID NO: 2017 - DNA, 16 bp, Artificial sequence
  Synthetic oligonucleotide
ctattaaacagcactc

SEQ ID NO: 2018 - DNA, 16 bp, Artificial sequence
  Synthetic oligonucleotide
gtgggagtcggagctc

SEQ ID NO: 2019 - DNA, 16 bp, Artificial sequence
  Synthetic oligonucleotide
gccaaggacaccacct

SEQ ID NO: 2020 - DNA, 16 bp, Artificial sequence
  Synthetic oligonucleotide
gtatttgtcgagatca

SEQ ID NO: 2021 - DNA, 16 bp, Artificial sequence
  Synthetic oligonucleotide
agttgtaaatgagtcg

SEQ ID NO: 2022 - DNA, 16 bp, Artificial sequence
  Synthetic oligonucleotide
gcggagcttcccgttg

SEQ ID NO: 2023 - DNA, 16 bp, Artificial sequence
  Synthetic oligonucleotide
aacaatcctgtacact

SEQ ID NO: 2024 - DNA, 16 bp, Artificial sequence
  Synthetic oligonucleotide
gcatagagcccgtcgg

SEQ ID NO: 2025 - DNA, 16 bp, Artificial sequence
  Synthetic oligonucleotide
aaagcatagagtcacc

SEQ ID NO: 2026 - DNA, 16 bp, Artificial sequence
  Synthetic oligonucleotide
ccgtatccccgtatca

SEQ ID NO: 2027 - DNA, 16 bp, Artificial sequence
  Synthetic oligonucleotide
tggcagtctacagaac

SEQ ID NO: 2028 - DNA, 16 bp, Artificial sequence
  Synthetic oligonucleotide
ggcaagttttctctgt

SEQ ID NO: 2029 - DNA, 16 bp, Artificial sequence
  Synthetic oligonucleotide
cagcaagtgtcttcca

SEQ ID NO: 2030 - DNA, 16 bp, Artificial sequence
  Synthetic oligonucleotide
gaagtttactaactgg

SEQ ID NO: 2031 - DNA, 16 bp, Artificial sequence
  Synthetic oligonucleotide
gcgaagaattttagca

SEQ ID NO: 2032 - DNA, 16 bp, Artificial sequence
  Synthetic oligonucleotide
aagggaacagatagtt

SEQ ID NO: 2033 - DNA, 16 bp, Artificial sequence
  Synthetic oligonucleotide
gtaattttaaggccct

SEQ ID NO: 2034 - DNA, 16 bp, Artificial sequence
  Synthetic oligonucleotide
aagtgataggtatact

SEQ ID NO: 2035 - DNA, 16 bp, Artificial sequence
  Synthetic oligonucleotide
gagagctacgcaatct

SEQ ID NO: 2036 - DNA, 16 bp, Artificial sequence
  Synthetic oligonucleotide
cacttttagagaggag

SEQ ID NO: 2037 - DNA, 16 bp, Artificial sequence
  Synthetic oligonucleotide
aacgaggtaaatcttc

SEQ ID NO: 2038 - DNA, 16 bp, Artificial sequence
  Synthetic oligonucleotide
ccaatacatatccatg

SEQ ID NO: 2039 - DNA, 16 bp, Artificial sequence
  Synthetic oligonucleotide
tcccttaggataatat

SEQ ID NO: 2040 - DNA, 16 bp, Artificial sequence
  Synthetic oligonucleotide
tccactgttaaagcag

SEQ ID NO: 2041 - DNA, 16 bp, Artificial sequence
  Synthetic oligonucleotide
gaatgaggaagccgtt

SEQ ID NO: 2042 - DNA, 16 bp, Artificial sequence
  Synthetic oligonucleotide
caatactgtaagggct

SEQ ID NO: 2043 - DNA, 16 bp, Artificial sequence
  Synthetic oligonucleotide
gccaagaggtgcgagt

SEQ ID NO: 2044 - DNA, 16 bp, Artificial sequence
  Synthetic oligonucleotide
ggaagtttacactgga

SEQ ID NO: 2045 - DNA, 16 bp, Artificial sequence
  Synthetic oligonucleotide
atcgagatcagtctca

SEQ ID NO: 2046 - DNA, 16 bp, Artificial sequence
  Synthetic oligonucleotide
caacacgggaatttcc

SEQ ID NO: 2047 - DNA, 16 bp, Artificial sequence
  Synthetic oligonucleotide
ctacctcagtttgtga

SEQ ID NO: 2048 - DNA, 16 bp, Artificial sequence
  Synthetic oligonucleotide
ctaaactcctaagtac

SEQ ID NO: 2049 - DNA, 16 bp, Artificial sequence
  Synthetic oligonucleotide
gctgaatgctctccat

SEQ ID NO: 2050 - DNA, 16 bp, Artificial sequence
  Synthetic oligonucleotide
gctcagcgcagatggg

SEQ ID NO: 2051 - DNA, 16 bp, Artificial sequence
  Synthetic oligonucleotide
cgcaaggctcggagcg

SEQ ID NO: 2052 - DNA, 16 bp, Artificial sequence
  Synthetic oligonucleotide
cccgaataggacccct

SEQ ID NO: 2053 - DNA, 16 bp, Artificial sequence
  Synthetic oligonucleotide
aggcaccttcgcggcc

SEQ ID NO: 2054 - DNA, 16 bp, Artificial sequence
  Synthetic oligonucleotide
cgcggacgcacggaga

SEQ ID NO: 2055 - DNA, 16 bp, Artificial sequence
  Synthetic oligonucleotide
cgcgcaaagggcaagg

SEQ ID NO: 2056 - DNA, 16 bp, Artificial sequence
  Synthetic oligonucleotide
gggtatttataaccgg

SEQ ID NO: 2057 - DNA, 16 bp, Artificial sequence
  Synthetic oligonucleotide
tgcctctgttaggtga

SEQ ID NO: 2058 - DNA, 16 bp, Artificial sequence
  Synthetic oligonucleotide
ttgaaagactaactgg

SEQ ID NO: 2059 - DNA, 16 bp, Artificial sequence
  Synthetic oligonucleotide
tgtgacataaaggacc

SEQ ID NO: 2060 - DNA, 16 bp, Artificial sequence
  Synthetic oligonucleotide
gttggagcagccatag

SEQ ID NO: 2061 - DNA, 16 bp, Artificial sequence
  Synthetic oligonucleotide
caaaagtaccacaggg

SEQ ID NO: 2062 - DNA, 16 bp, Artificial sequence
  Synthetic oligonucleotide
ttattagactgacagc

SEQ ID NO: 2063 - DNA, 16 bp, Artificial sequence
  Synthetic oligonucleotide
gcaattagctcttcta

SEQ ID NO: 2064 - DNA, 16 bp, Artificial sequence
  Synthetic oligonucleotide
ctatataaaaagtggg

SEQ ID NO: 2065 - DNA, 16 bp, Artificial sequence
  Synthetic oligonucleotide
tgctagattctccctg

SEQ ID NO: 2066 - DNA, 16 bp, Artificial sequence
  Synthetic oligonucleotide
tggaaaccagcccttg

SEQ ID NO: 2067 - DNA, 16 bp, Artificial sequence
  Synthetic oligonucleotide
acctactccatcactt

SEQ ID NO: 2068 - DNA, 16 bp, Artificial sequence
  Synthetic oligonucleotide
ctgtaactgactaaca

SEQ ID NO: 2069 - DNA, 16 bp, Artificial sequence
  Synthetic oligonucleotide
aagcaagtgtctaaag

SEQ ID NO: 2070 - DNA, 16 bp, Artificial sequence
  Synthetic oligonucleotide
ctacacttccaagcaa

SEQ ID NO: 2071 - DNA, 16 bp, Artificial sequence
  Synthetic oligonucleotide
tatagtaggtaagatc

SEQ ID NO: 2072 - DNA, 16 bp, Artificial sequence
  Synthetic oligonucleotide
ctagaaagagctggta

SEQ ID NO: 2073 - DNA, 16 bp, Artificial sequence
  Synthetic oligonucleotide
tcagacagtgcgcccc

SEQ ID NO: 2074 - DNA, 16 bp, Artificial sequence
  Synthetic oligonucleotide
aaatatcgcccatgag

SEQ ID NO: 2075 - DNA, 16 bp, Artificial sequence
  Synthetic oligonucleotide
tatatagaattaggtg

SEQ ID NO: 2076 - DNA, 16 bp, Artificial sequence
  Synthetic oligonucleotide
taaggaacaagtgtat

SEQ ID NO: 2077 - DNA, 16 bp, Artificial sequence
  Synthetic oligonucleotide
ccggagtcagtgctgg

SEQ ID NO: 2078 - DNA, 16 bp, Artificial sequence
  Synthetic oligonucleotide
cgtatttgtcgagatc

SEQ ID NO: 2079 - DNA, 16 bp, Artificial sequence
  Synthetic oligonucleotide
tcacagagccaactta

SEQ ID NO: 2080 - DNA, 16 bp, Artificial sequence
  Synthetic oligonucleotide
ttacacccagaagtac

SEQ ID NO: 2081 - DNA, 16 bp, Artificial sequence
  Synthetic oligonucleotide
gcccatgtgagctctt

SEQ ID NO: 2082 - DNA, 16 bp, Artificial sequence
  Synthetic oligonucleotide
gaacactttgaggtga

SEQ ID NO: 2083 - DNA, 16 bp, Artificial sequence
  Synthetic oligonucleotide
gactacacctacacag

SEQ ID NO: 2084 - DNA, 16 bp, Artificial sequence
  Synthetic oligonucleotide
agccgctacagcttct

SEQ ID NO: 2085 - DNA, 16 bp, Artificial sequence
  Synthetic oligonucleotide
gatacaaaacggactg

SEQ ID NO: 2086 - DNA, 16 bp, Artificial sequence
  Synthetic oligonucleotide
gcccacataatccagt

SEQ ID NO: 2087 - DNA, 16 bp, Artificial sequence
  Synthetic oligonucleotide
gaggaactagtcgaca

SEQ ID NO: 2088 - DNA, 16 bp, Artificial sequence
  Synthetic oligonucleotide
taggagtgtaactgag

SEQ ID NO: 2089 - DNA, 16 bp, Artificial sequence
  Synthetic oligonucleotide
gaaatacgacaacttt

SEQ ID NO: 2090 - DNA, 16 bp, Artificial sequence
  Synthetic oligonucleotide
tacgagagggtctgat

SEQ ID NO: 2091 - DNA, 16 bp, Artificial sequence
  Synthetic oligonucleotide
tttacctggtattgct

SEQ ID NO: 2092 - DNA, 16 bp, Artificial sequence
  Synthetic oligonucleotide
tgcttatcaatgccaa

SEQ ID NO: 2093 - DNA, 16 bp, Artificial sequence
  Synthetic oligonucleotide
gaactcataggtgtac

SEQ ID NO: 2094 - DNA, 16 bp, Artificial sequence
  Synthetic oligonucleotide
cactattaaacagcac

SEQ ID NO: 2095 - DNA, 16 bp, Artificial sequence
  Synthetic oligonucleotide
atcaagtaaagtgatc

SEQ ID NO: 2096 - DNA, 16 bp, Artificial sequence
  Synthetic oligonucleotide
tcagttgtaaatgagt

SEQ ID NO: 2097 - DNA, 16 bp, Artificial sequence
  Synthetic oligonucleotide
ggcggagcttcccgtt

SEQ ID NO: 2098 - DNA, 16 bp, Artificial sequence
  Synthetic oligonucleotide
aggaacaatcctgtac

SEQ ID NO: 2099 - DNA, 16 bp, Artificial sequence
  Synthetic oligonucleotide
cgcatagagcccgtcg

SEQ ID NO: 2100 - DNA, 16 bp, Artificial sequence
  Synthetic oligonucleotide
caaagcatagagtcac

SEQ ID NO: 2101 - DNA, 16 bp, Artificial sequence
  Synthetic oligonucleotide
ccccgtatccccgtat

SEQ ID NO: 2102 - DNA, 16 bp, Artificial sequence
  Synthetic oligonucleotide
aatgatggcagtctac

SEQ ID NO: 2103 - DNA, 16 bp, Artificial sequence
  Synthetic oligonucleotide
gtcaatactgaaaggc

SEQ ID NO: 2104 - DNA, 16 bp, Artificial sequence
  Synthetic oligonucleotide
tcagcaagtgtcttcc

SEQ ID NO: 2105 - DNA, 16 bp, Artificial sequence
  Synthetic oligonucleotide
taggaagtttactaac

SEQ ID NO: 2106 - DNA, 16 bp, Artificial sequence
  Synthetic oligonucleotide
tgcgaagaattttagc

SEQ ID NO: 2107 - DNA, 16 bp, Artificial sequence
  Synthetic oligonucleotide
gaagggaacagatagt

SEQ ID NO: 2108 - DNA, 16 bp, Artificial sequence
  Synthetic oligonucleotide
agtaattttaaggccc

SEQ ID NO: 2109 - DNA, 16 bp, Artificial sequence
  Synthetic oligonucleotide
taagtgataggtatac

SEQ ID NO: 2110 - DNA, 16 bp, Artificial sequence
  Synthetic oligonucleotide
cacatttgagagctac

SEQ ID NO: 2111 - DNA, 16 bp, Artificial sequence
  Synthetic oligonucleotide
acacttttagagagga

SEQ ID NO: 2112 - DNA, 16 bp, Artificial sequence
  Synthetic oligonucleotide
gaacgaggtaaatctt

SEQ ID NO: 2113 - DNA, 16 bp, Artificial sequence
  Synthetic oligonucleotide
cccaatacatatccat

SEQ ID NO: 2114 - DNA, 16 bp, Artificial sequence
  Synthetic oligonucleotide
cgtgaaacagcagttc

SEQ ID NO: 2115 - DNA, 16 bp, Artificial sequence
  Synthetic oligonucleotide
ctccactgttaaagca

SEQ ID NO: 2116 - DNA, 16 bp, Artificial sequence
  Synthetic oligonucleotide
aggaatgaggaagccg

SEQ ID NO: 2117 - DNA, 16 bp, Artificial sequence
  Synthetic oligonucleotide
aacaatactgtaaggg

SEQ ID NO: 2118 - DNA, 16 bp, Artificial sequence
  Synthetic oligonucleotide
agccaagaggtgcgag

SEQ ID NO: 2119 - DNA, 16 bp, Artificial sequence
  Synthetic oligonucleotide
cggaagtttacactgg

SEQ ID NO: 2120 - DNA, 16 bp, Artificial sequence
  Synthetic oligonucleotide
catcgagatcagtctc

SEQ ID NO: 2121 - DNA, 16 bp, Artificial sequence
  Synthetic oligonucleotide
agcaacacgggaattt

SEQ ID NO: 2122 - DNA, 16 bp, Artificial sequence
  Synthetic oligonucleotide
cattatctacctcagt

SEQ ID NO: 2123 - DNA, 16 bp, Artificial sequence
  Synthetic oligonucleotide
gctaaactcctaagta

SEQ ID NO: 2124 - DNA, 16 bp, Artificial sequence
  Synthetic oligonucleotide
agctgaatgctctcca

SEQ ID NO: 2125 - DNA, 16 bp, Artificial sequence
  Synthetic oligonucleotide
ggccttggagcccaaa

SEQ ID NO: 2126 - DNA, 16 bp, Artificial sequence
  Synthetic oligonucleotide
acgcaaggctcggagc

SEQ ID NO: 2127 - DNA, 16 bp, Artificial sequence
  Synthetic oligonucleotide
ccccgaataggacccc

SEQ ID NO: 2128 - DNA, 16 bp, Artificial sequence
  Synthetic oligonucleotide
gaagaaggcaccttcg

SEQ ID NO: 2129 - DNA, 16 bp, Artificial sequence
  Synthetic oligonucleotide
gcaaaacccctcaagc

SEQ ID NO: 2130 - DNA, 16 bp, Artificial sequence
  Synthetic oligonucleotide
gcgcggacgcacggag

SEQ ID NO: 2131 - DNA, 16 bp, Artificial sequence
  Synthetic oligonucleotide
tgcactcgcgcaaagg

SEQ ID NO: 2132 - DNA, 16 bp, Artificial sequence
  Synthetic oligonucleotide
gccaagttgaagacac

SEQ ID NO: 2133 - DNA, 16 bp, Artificial sequence
  Synthetic oligonucleotide
agttaaggtgcctcaa

SEQ ID NO: 2134 - DNA, 16 bp, Artificial sequence
  Synthetic oligonucleotide
taacaagttatccagt

SEQ ID NO: 2135 - DNA, 16 bp, Artificial sequence
  Synthetic oligonucleotide
tgcgaatgtgccttgt

SEQ ID NO: 2136 - DNA, 16 bp, Artificial sequence
  Synthetic oligonucleotide
cagcaccgtgtggaaa

SEQ ID NO: 2137 - DNA, 16 bp, Artificial sequence
  Synthetic oligonucleotide
tggcaccaaaagtacc

SEQ ID NO: 2138 - DNA, 16 bp, Artificial sequence
  Synthetic oligonucleotide
cttattagactgacag

SEQ ID NO: 2139 - DNA, 16 bp, Artificial sequence
  Synthetic oligonucleotide
ccacattagcaattag

SEQ ID NO: 2140 - DNA, 16 bp, Artificial sequence
  Synthetic oligonucleotide
tttatgagcttccaca

SEQ ID NO: 2141 - DNA, 16 bp, Artificial sequence
  Synthetic oligonucleotide
ccgcattgctagattc

SEQ ID NO: 2142 - DNA, 16 bp, Artificial sequence
  Synthetic oligonucleotide
ttggaaaccagccctt

SEQ ID NO: 2143 - DNA, 16 bp, Artificial sequence
  Synthetic oligonucleotide
tctacctactccatca

SEQ ID NO: 2144 - DNA, 16 bp, Artificial sequence
  Synthetic oligonucleotide
aggaaacttggagcgc

SEQ ID NO: 2145 - DNA, 16 bp, Artificial sequence
  Synthetic oligonucleotide
gcaaagcaagtgtcta

SEQ ID NO: 2146 - DNA, 16 bp, Artificial sequence
  Synthetic oligonucleotide
gaaggatgatcagctt

SEQ ID NO: 2147 - DNA, 16 bp, Artificial sequence
  Synthetic oligonucleotide
ttatagtaggtaagat

SEQ ID NO: 2148 - DNA, 16 bp, Artificial sequence
  Synthetic oligonucleotide
tgcaagcctcattcac

SEQ ID NO: 2149 - DNA, 16 bp, Artificial sequence
  Synthetic oligonucleotide
agtcagacagtgcgcc

SEQ ID NO: 2150 - DNA, 16 bp, Artificial sequence
  Synthetic oligonucleotide
aaaatatcgcccatga

SEQ ID NO: 2151 - DNA, 16 bp, Artificial sequence
  Synthetic oligonucleotide
tgacatcatttaggta

SEQ ID NO: 2152 - DNA, 16 bp, Artificial sequence
  Synthetic oligonucleotide
ggccaccgactctttt

SEQ ID NO: 2153 - DNA, 16 bp, Artificial sequence
  Synthetic oligonucleotide
ataacgaggtgcctta

SEQ ID NO: 2154 - DNA, 16 bp, Artificial sequence
  Synthetic oligonucleotide
cgccacatcagcagac

SEQ ID NO: 2155 - DNA, 16 bp, Artificial sequence
  Synthetic oligonucleotide
acttacacccagaagt

SEQ ID NO: 2156 - DNA, 16 bp, Artificial sequence
  Synthetic oligonucleotide
ggccttagccttcctg

SEQ ID NO: 2157 - DNA, 16 bp, Artificial sequence
  Synthetic oligonucleotide
gcagaagctggttggc

SEQ ID NO: 2158 - DNA, 16 bp, Artificial sequence
  Synthetic oligonucleotide
tgagactacacctaca

SEQ ID NO: 2159 - DNA, 16 bp, Artificial sequence
  Synthetic oligonucleotide
acaggagccgctacag

SEQ ID NO: 2160 - DNA, 16 bp, Artificial sequence
  Synthetic oligonucleotide
aagatacaaaacggac

SEQ ID NO: 2161 - DNA, 16 bp, Artificial sequence
  Synthetic oligonucleotide
cctcactacagagccc

SEQ ID NO: 2162 - DNA, 16 bp, Artificial sequence
  Synthetic oligonucleotide
tcaagaggaactagtc

SEQ ID NO: 2163 - DNA, 16 bp, Artificial sequence
  Synthetic oligonucleotide
gtaggagtgtaactga

SEQ ID NO: 2164 - DNA, 16 bp, Artificial sequence
  Synthetic oligonucleotide
ggaaatacgacaactt

SEQ ID NO: 2165 - DNA, 16 bp, Artificial sequence
  Synthetic oligonucleotide
ttacgagagggtctga

SEQ ID NO: 2166 - DNA, 16 bp, Artificial sequence
  Synthetic oligonucleotide
ttttacctggtattgc

SEQ ID NO: 2167 - DNA, 16 bp, Artificial sequence
  Synthetic oligonucleotide
gatcatcaacttctta

SEQ ID NO: 2168 - DNA, 16 bp, Artificial sequence
  Synthetic oligonucleotide
tggaactcataggtgt

SEQ ID NO: 2169 - DNA, 16 bp, Artificial sequence
  Synthetic oligonucleotide
ctgcatcaaatcaagt

SEQ ID NO: 2170 - DNA, 16 bp, Artificial sequence
  Synthetic oligonucleotide
tcactattaaacagca

SEQ ID NO: 2171 - DNA, 16 bp, Artificial sequence
  Synthetic oligonucleotide
gttcatatcacagagc

SEQ ID NO: 2172 - DNA, 16 bp, Artificial sequence
  Synthetic oligonucleotide
ggtttcagttgtaaat

SEQ ID NO: 2173 - DNA, 16 bp, Artificial sequence
  Synthetic oligonucleotide
gccactggcggagctt

SEQ ID NO: 2174 - DNA, 16 bp, Artificial sequence
  Synthetic oligonucleotide
atggacatctgcgggt

SEQ ID NO: 2175 - DNA, 16 bp, Artificial sequence
  Synthetic oligonucleotide
tcgcatagagcccgtc

SEQ ID NO: 2176 - DNA, 16 bp, Artificial sequence
  Synthetic oligonucleotide
ccaaagcatagagtca

SEQ ID NO: 2177 - DNA, 16 bp, Artificial sequence
  Synthetic oligonucleotide
caagaccccgtatccc

SEQ ID NO: 2178 - DNA, 16 bp, Artificial sequence
  Synthetic oligonucleotide
caatgatggcagtcta

SEQ ID NO: 2179 - DNA, 16 bp, Artificial sequence
  Synthetic oligonucleotide
tgtcaatactgaaagg

SEQ ID NO: 2180 - DNA, 16 bp, Artificial sequence
  Synthetic oligonucleotide
ctcagcaagtgtcttc

SEQ ID NO: 2181 - DNA, 16 bp, Artificial sequence
  Synthetic oligonucleotide
ataggaagtttactaa

SEQ ID NO: 2182 - DNA, 16 bp, Artificial sequence
  Synthetic oligonucleotide
atgcgaagaattttag

SEQ ID NO: 2183 - DNA, 16 bp, Artificial sequence
  Synthetic oligonucleotide
ggacagccaaacaaac

SEQ ID NO: 2184 - DNA, 16 bp, Artificial sequence
  Synthetic oligonucleotide
caagtaattttaaggc

SEQ ID NO: 2185 - DNA, 16 bp, Artificial sequence
  Synthetic oligonucleotide
tgtaagtgataggtat

SEQ ID NO: 2186 - DNA, 16 bp, Artificial sequence
  Synthetic oligonucleotide
acacatttgagagcta

SEQ ID NO: 2187 - DNA, 16 bp, Artificial sequence
  Synthetic oligonucleotide
ggacacttttagagag

SEQ ID NO: 2188 - DNA, 16 bp, Artificial sequence
  Synthetic oligonucleotide
agaacgaggtaaatct

SEQ ID NO: 2189 - DNA, 16 bp, Artificial sequence
  Synthetic oligonucleotide
gcccaatacatatcca

SEQ ID NO: 2190 - DNA, 16 bp, Artificial sequence
  Synthetic oligonucleotide
ccgtgaaacagcagtt

SEQ ID NO: 2191 - DNA, 16 bp, Artificial sequence
  Synthetic oligonucleotide
agctccactgttaaag

SEQ ID NO: 2192 - DNA, 16 bp, Artificial sequence
  Synthetic oligonucleotide
ctttatcaagacaagg

SEQ ID NO: 2193 - DNA, 16 bp, Artificial sequence
  Synthetic oligonucleotide
taacaatactgtaagg

SEQ ID NO: 2194 - DNA, 16 bp, Artificial sequence
  Synthetic oligonucleotide
gcggagcatcaacaaa

SEQ ID NO: 2195 - DNA, 16 bp, Artificial sequence
  Synthetic oligonucleotide
acggaagtttacactg

SEQ ID NO: 2196 - DNA, 16 bp, Artificial sequence
  Synthetic oligonucleotide
gcatcgagatcagtct

SEQ ID NO: 2197 - DNA, 16 bp, Artificial sequence
  Synthetic oligonucleotide
aagcaacacgggaatt

SEQ ID NO: 2198 - DNA, 16 bp, Artificial sequence
  Synthetic oligonucleotide
gcattatctacctcag

SEQ ID NO: 2199 - DNA, 16 bp, Artificial sequence
  Synthetic oligonucleotide
agctaaactcctaagt

SEQ ID NO: 2200 - DNA, 16 bp, Artificial sequence
  Synthetic oligonucleotide
ggcaagctgaatgctc

SEQ ID NO: 2201 - DNA, 16 bp, Artificial sequence
  Synthetic oligonucleotide
aaggaggcgggccttg

SEQ ID NO: 2202 - DNA, 16 bp, Artificial sequence
  Synthetic oligonucleotide
ccgcacgcaaggctcg

SEQ ID NO: 2203 - DNA, 16 bp, Artificial sequence
  Synthetic oligonucleotide
tcgcatccagaccctt

SEQ ID NO: 2204 - DNA, 16 bp, Artificial sequence
  Synthetic oligonucleotide
cggaagaaggcacctt

SEQ ID NO: 2205 - DNA, 16 bp, Artificial sequence
  Synthetic oligonucleotide
cgcaaaacccctcaag

SEQ ID NO: 2206 - DNA, 16 bp, Artificial sequence
  Synthetic oligonucleotide
cacaggcgcggacgca

SEQ ID NO: 2207 - DNA, 16 bp, Artificial sequence
  Synthetic oligonucleotide
gtaacaacgacacacg

SEQ ID NO: 2208 - DNA, 16 bp, Artificial sequence
  Synthetic oligonucleotide
ccctatcactgccaag

SEQ ID NO: 2209 - DNA, 16 bp, Artificial sequence
  Synthetic oligonucleotide
cagaatgaagttaagg

SEQ ID NO: 2210 - DNA, 16 bp, Artificial sequence
  Synthetic oligonucleotide
gactattagataagta

SEQ ID NO: 2211 - DNA, 16 bp, Artificial sequence
  Synthetic oligonucleotide
cagatggcatgcgaat

SEQ ID NO: 2212 - DNA, 16 bp, Artificial sequence
  Synthetic oligonucleotide
ggcagcaccgtgtgga

SEQ ID NO: 2213 - DNA, 16 bp, Artificial sequence
  Synthetic oligonucleotide
ggctaaacctggcacc

SEQ ID NO: 2214 - DNA, 16 bp, Artificial sequence
  Synthetic oligonucleotide
ccttattagactgaca

SEQ ID NO: 2215 - DNA, 16 bp, Artificial sequence
  Synthetic oligonucleotide
gccacattagcaatta

SEQ ID NO: 2216 - DNA, 16 bp, Artificial sequence
  Synthetic oligonucleotide
cttattatttatgagc

SEQ ID NO: 2217 - DNA, 16 bp, Artificial sequence
  Synthetic oligonucleotide
taccgcattgctagat

SEQ ID NO: 2218 - DNA, 16 bp, Artificial sequence
  Synthetic oligonucleotide
catattggaaaccagc

SEQ ID NO: 2219 - DNA, 16 bp, Artificial sequence
  Synthetic oligonucleotide
caagacaggtctctac

SEQ ID NO: 2220 - DNA, 16 bp, Artificial sequence
  Synthetic oligonucleotide
aaggaaacttggagcg

SEQ ID NO: 2221 - DNA, 16 bp, Artificial sequence
  Synthetic oligonucleotide
agcaaagcaagtgtct

SEQ ID NO: 2222 - DNA, 16 bp, Artificial sequence
  Synthetic oligonucleotide
tcaacctggaaggatg

SEQ ID NO: 2223 - DNA, 16 bp, Artificial sequence
  Synthetic oligonucleotide
tttatagtaggtaaga

SEQ ID NO: 2224 - DNA, 16 bp, Artificial sequence
  Synthetic oligonucleotide
aaaaaaggtgcaagcc

SEQ ID NO: 2225 - DNA, 16 bp, Artificial sequence
  Synthetic oligonucleotide
agcgagtcagacagtg

SEQ ID NO: 2226 - DNA, 16 bp, Artificial sequence
  Synthetic oligonucleotide
ttaaaatatcgcccat

SEQ ID NO: 2227 - DNA, 16 bp, Artificial sequence
  Synthetic oligonucleotide
agcaagtcggtccaca

SEQ ID NO: 2228 - DNA, 16 bp, Artificial sequence
  Synthetic oligonucleotide
cagcatattacaaacg

SEQ ID NO: 2229 - DNA, 16 bp, Artificial sequence
  Synthetic oligonucleotide
gataacgaggtgcctt

SEQ ID NO: 2230 - DNA, 16 bp, Artificial sequence
  Synthetic oligonucleotide
actcactggttctgaa

SEQ ID NO: 2231 - DNA, 16 bp, Artificial sequence
  Synthetic oligonucleotide
gtcacttacacccaga

SEQ ID NO: 2232 - DNA, 16 bp, Artificial sequence
  Synthetic oligonucleotide
gtccagagtcttcaga

SEQ ID NO: 2233 - DNA, 16 bp, Artificial sequence
  Synthetic oligonucleotide
taattatgcagaagct

SEQ ID NO: 2234 - DNA, 16 bp, Artificial sequence
  Synthetic oligonucleotide
tctgagactacaccta

SEQ ID NO: 2235 - DNA, 16 bp, Artificial sequence
  Synthetic oligonucleotide
gttgacacaggagccg

SEQ ID NO: 2236 - DNA, 16 bp, Artificial sequence
  Synthetic oligonucleotide
aaagatacaaaacgga

SEQ ID NO: 2237 - DNA, 16 bp, Artificial sequence
  Synthetic oligonucleotide
taaaacctcatcccct

SEQ ID NO: 2238 - DNA, 16 bp, Artificial sequence
  Synthetic oligonucleotide
ttcaagaggaactagt

SEQ ID NO: 2239 - DNA, 16 bp, Artificial sequence
  Synthetic oligonucleotide
actatggtaggagtgt

SEQ ID NO: 2240 - DNA, 16 bp, Artificial sequence
  Synthetic oligonucleotide
atggaaatacgacaac

SEQ ID NO: 2241 - DNA, 16 bp, Artificial sequence
  Synthetic oligonucleotide
cattacgagagggtct

SEQ ID NO: 2242 - DNA, 16 bp, Artificial sequence
  Synthetic oligonucleotide
aacttttacctggtat

SEQ ID NO: 2243 - DNA, 16 bp, Artificial sequence
  Synthetic oligonucleotide
ggccgatcatcaactt

SEQ ID NO: 2244 - DNA, 16 bp, Artificial sequence
  Synthetic oligonucleotide
gtggaactcataggtg

SEQ ID NO: 2245 - DNA, 16 bp, Artificial sequence
  Synthetic oligonucleotide
taactaaaactgcatc

SEQ ID NO: 2246 - DNA, 16 bp, Artificial sequence
  Synthetic oligonucleotide
ctcactattaaacagc

SEQ ID NO: 2247 - DNA, 16 bp, Artificial sequence
  Synthetic oligonucleotide
agccgccacatcagca

SEQ ID NO: 2248 - DNA, 16 bp, Artificial sequence
  Synthetic oligonucleotide
agccactggcggagct

SEQ ID NO: 2249 - DNA, 16 bp, Artificial sequence
  Synthetic oligonucleotide
gctcatggacatctgc

SEQ ID NO: 2250 - DNA, 16 bp, Artificial sequence
  Synthetic oligonucleotide
agtcttttcgcataga

SEQ ID NO: 2251 - DNA, 16 bp, Artificial sequence
  Synthetic oligonucleotide
ctccaaagcatagagt

SEQ ID NO: 2252 - DNA, 16 bp, Artificial sequence
  Synthetic oligonucleotide
aatcacttgtcttggg

SEQ ID NO: 2253 - DNA, 16 bp, Artificial sequence
  Synthetic oligonucleotide
tcaatgatggcagtct

SEQ ID NO: 2254 - DNA, 16 bp, Artificial sequence
  Synthetic oligonucleotide
agtcagtgtcaatact

SEQ ID NO: 2255 - DNA, 16 bp, Artificial sequence
  Synthetic oligonucleotide
actcagcaagtgtctt

SEQ ID NO: 2256 - DNA, 16 bp, Artificial sequence
  Synthetic oligonucleotide
gctcatgttttttgac

SEQ ID NO: 2257 - DNA, 16 bp, Artificial sequence
  Synthetic oligonucleotide
ctttatgcgaagaatt

SEQ ID NO: 2258 - DNA, 16 bp, Artificial sequence
  Synthetic oligonucleotide
cgctggacagccaaac

SEQ ID NO: 2259 - DNA, 16 bp, Artificial sequence
  Synthetic oligonucleotide
gccaagtaattttaag

SEQ ID NO: 2260 - DNA, 16 bp, Artificial sequence
  Synthetic oligonucleotide
atgtaagtgataggta

SEQ ID NO: 2261 - DNA, 16 bp, Artificial sequence
  Synthetic oligonucleotide
tatccattagaaaagc

SEQ ID NO: 2262 - DNA, 16 bp, Artificial sequence
  Synthetic oligonucleotide
tggacacttttagaga

SEQ ID NO: 2263 - DNA, 16 bp, Artificial sequence
  Synthetic oligonucleotide
cagaacgaggtaaatc

SEQ ID NO: 2264 - DNA, 16 bp, Artificial sequence
  Synthetic oligonucleotide
tgcccaatacatatcc

SEQ ID NO: 2265 - DNA, 16 bp, Artificial sequence
  Synthetic oligonucleotide
ggtaagggccccgtga

SEQ ID NO: 2266 - DNA, 16 bp, Artificial sequence
  Synthetic oligonucleotide
aaggaggtagtggccc

SEQ ID NO: 2267 - DNA, 16 bp, Artificial sequence
  Synthetic oligonucleotide
gccaattccactttat

SEQ ID NO: 2268 - DNA, 16 bp, Artificial sequence
  Synthetic oligonucleotide
tcctaggtttcagttg

SEQ ID NO: 2269 - DNA, 16 bp, Artificial sequence
  Synthetic oligonucleotide
gtaacaatactgtaag

SEQ ID NO: 2270 - DNA, 16 bp, Artificial sequence
  Synthetic oligonucleotide
ggcggagcatcaacaa

SEQ ID NO: 2271 - DNA, 16 bp, Artificial sequence
  Synthetic oligonucleotide
aacggaagtttacact

SEQ ID NO: 2272 - DNA, 16 bp, Artificial sequence
  Synthetic oligonucleotide
ctgcatcgagatcagt

SEQ ID NO: 2273 - DNA, 16 bp, Artificial sequence
  Synthetic oligonucleotide
tgaagcaacacgggaa

SEQ ID NO: 2274 - DNA, 16 bp, Artificial sequence
  Synthetic oligonucleotide
agcattatctacctca

SEQ ID NO: 2275 - DNA, 16 bp, Artificial sequence
  Synthetic oligonucleotide
aagctaaactcctaag

SEQ ID NO: 2276 - DNA, 16 bp, Artificial sequence
  Synthetic oligonucleotide
tctaaggcaagctgaa

SEQ ID NO: 2277 - DNA, 16 bp, Artificial sequence
  Synthetic oligonucleotide
caaggaggcgggcctt

SEQ ID NO: 2278 - DNA, 16 bp, Artificial sequence
  Synthetic oligonucleotide
ggctaggccaccgcac

SEQ ID NO: 2279 - DNA, 16 bp, Artificial sequence
  Synthetic oligonucleotide
gaggacctcgcctgcg

SEQ ID NO: 2280 - DNA, 16 bp, Artificial sequence
  Synthetic oligonucleotide
ccggaagaaggcacct

SEQ ID NO: 2281 - DNA, 16 bp, Artificial sequence
  Synthetic oligonucleotide
gcgcaaaacccctcaa

SEQ ID NO: 2282 - DNA, 16 bp, Artificial sequence
  Synthetic oligonucleotide
cggcacaggcgcggac

SEQ ID NO: 2283 - DNA, 16 bp, Artificial sequence
  Synthetic oligonucleotide
gtaaactgccttaggg

SEQ ID NO: 2284 - DNA, 16 bp, Artificial sequence
  Synthetic oligonucleotide
aaagaccccagctatg

SEQ ID NO: 2285 - DNA, 16 bp, Artificial sequence
  Synthetic oligonucleotide
gctcagaatgaagtta

SEQ ID NO: 2286 - DNA, 16 bp, Artificial sequence
  Synthetic oligonucleotide
aagactattagataag

SEQ ID NO: 2287 - DNA, 16 bp, Artificial sequence
  Synthetic oligonucleotide
gtacaggacaggtaaa

SEQ ID NO: 2288 - DNA, 16 bp, Artificial sequence
  Synthetic oligonucleotide
accaatggcagcaccg

SEQ ID NO: 2289 - DNA, 16 bp, Artificial sequence
  Synthetic oligonucleotide
tatggctaaacctggc

SEQ ID NO: 2290 - DNA, 16 bp, Artificial sequence
  Synthetic oligonucleotide
cccttattagactgac

SEQ ID NO: 2291 - DNA, 16 bp, Artificial sequence
  Synthetic oligonucleotide
gaccaggattcgccat

SEQ ID NO: 2292 - DNA, 16 bp, Artificial sequence
  Synthetic oligonucleotide
tgagttaccgcattgc

SEQ ID NO: 2293 - DNA, 16 bp, Artificial sequence
  Synthetic oligonucleotide
accatattggaaacca

SEQ ID NO: 2294 - DNA, 16 bp, Artificial sequence
  Synthetic oligonucleotide
tgttaccgatgcttca

SEQ ID NO: 2295 - DNA, 16 bp, Artificial sequence
  Synthetic oligonucleotide
gaaacgagccagtgca

SEQ ID NO: 2296 - DNA, 16 bp, Artificial sequence
  Synthetic oligonucleotide
gagcaaagcaagtgtc

SEQ ID NO: 2297 - DNA, 16 bp, Artificial sequence
  Synthetic oligonucleotide
gctcaacctggaagga

SEQ ID NO: 2298 - DNA, 16 bp, Artificial sequence
  Synthetic oligonucleotide
cttctttatagtaggt

SEQ ID NO: 2299 - DNA, 16 bp, Artificial sequence
  Synthetic oligonucleotide
tcacgagcacctcaga

SEQ ID NO: 2300 - DNA, 16 bp, Artificial sequence
  Synthetic oligonucleotide
ttcaacacactgtctg

SEQ ID NO: 2301 - DNA, 16 bp, Artificial sequence
  Synthetic oligonucleotide
ctctttaaaatatcgc

SEQ ID NO: 2302 - DNA, 16 bp, Artificial sequence
  Synthetic oligonucleotide
aagcaagtcggtccac

SEQ ID NO: 2303 - DNA, 16 bp, Artificial sequence
  Synthetic oligonucleotide
tctaaaccagcatatt

SEQ ID NO: 2304 - DNA, 16 bp, Artificial sequence
  Synthetic oligonucleotide
aaaagagccgccacat

SEQ ID NO: 2305 - DNA, 16 bp, Artificial sequence
  Synthetic oligonucleotide
catgaaatccaaggta

SEQ ID NO: 2306 - DNA, 16 bp, Artificial sequence
  Synthetic oligonucleotide
aaaaacttgggtcact

SEQ ID NO: 2307 - DNA, 16 bp, Artificial sequence
  Synthetic oligonucleotide
caccaaggtccagagt

SEQ ID NO: 2308 - DNA, 16 bp, Artificial sequence
  Synthetic oligonucleotide
tcacactgccgtgatc

SEQ ID NO: 2309 - DNA, 16 bp, Artificial sequence
  Synthetic oligonucleotide
aacgagttgacacagg

SEQ ID NO: 2310 - DNA, 16 bp, Artificial sequence
  Synthetic oligonucleotide
gtacatcctgaagcca

SEQ ID NO: 2311 - DNA, 16 bp, Artificial sequence
  Synthetic oligonucleotide
atcagaatgtttcgac

SEQ ID NO: 2312 - DNA, 16 bp, Artificial sequence
  Synthetic oligonucleotide
ccccagggccctcggt

SEQ ID NO: 2313 - DNA, 16 bp, Artificial sequence
  Synthetic oligonucleotide
cactatggtaggagtg

SEQ ID NO: 2314 - DNA, 16 bp, Artificial sequence
  Synthetic oligonucleotide
gggcaactttaaccat

SEQ ID NO: 2315 - DNA, 16 bp, Artificial sequence
  Synthetic oligonucleotide
gaacattacgagaggg

SEQ ID NO: 2316 - DNA, 16 bp, Artificial sequence
  Synthetic oligonucleotide
ggtgtaacttttacct

SEQ ID NO: 2317 - DNA, 16 bp, Artificial sequence
  Synthetic oligonucleotide
gatcatcaacttcttt

SEQ ID NO: 2318 - DNA, 16 bp, Artificial sequence
  Synthetic oligonucleotide
cctaagtacctgaaat

SEQ ID NO: 2319 - DNA, 16 bp, Artificial sequence
  Synthetic oligonucleotide
tcaaatcgactgccac

SEQ ID NO: 2320 - DNA, 16 bp, Artificial sequence
  Synthetic oligonucleotide
gctcactattaaacag

SEQ ID NO: 2321 - DNA, 16 bp, Artificial sequence
  Synthetic oligonucleotide
caataatctcccagca

SEQ ID NO: 2322 - DNA, 16 bp, Artificial sequence
  Synthetic oligonucleotide
agataacgaggtgcct

SEQ ID NO: 2323 - DNA, 16 bp, Artificial sequence
  Synthetic oligonucleotide
ttaattatgcagaagc

SEQ ID NO: 2324 - DNA, 16 bp, Artificial sequence
  Synthetic oligonucleotide
tgccgctgtcgatctg

SEQ ID NO: 2325 - DNA, 16 bp, Artificial sequence
  Synthetic oligonucleotide
ggctcatggacatctg

SEQ ID NO: 2326 - DNA, 16 bp, Artificial sequence
  Synthetic oligonucleotide
tggcacagtcttttcg

SEQ ID NO: 2327 - DNA, 16 bp, Artificial sequence
  Synthetic oligonucleotide
ggctagcagaggttct

SEQ ID NO: 2328 - DNA, 16 bp, Artificial sequence
  Synthetic oligonucleotide
cgctttcactaaagtc

SEQ ID NO: 2329 - DNA, 16 bp, Artificial sequence
  Synthetic oligonucleotide
catcaatgatggcagt

SEQ ID NO: 2330 - DNA, 16 bp, Artificial sequence
  Synthetic oligonucleotide
ctctagtcagtgtcaa

SEQ ID NO: 2331 - DNA, 16 bp, Artificial sequence
  Synthetic oligonucleotide
cactcagcaagtgtct

SEQ ID NO: 2332 - DNA, 16 bp, Artificial sequence
  Synthetic oligonucleotide
tcccatccaagagtag

SEQ ID NO: 2333 - DNA, 16 bp, Artificial sequence
  Synthetic oligonucleotide
tctttatgcgaagaat

SEQ ID NO: 2334 - DNA, 16 bp, Artificial sequence
  Synthetic oligonucleotide
cgccatggctgatcgc

SEQ ID NO: 2335 - DNA, 16 bp, Artificial sequence
  Synthetic oligonucleotide
gtctttgggattctat

SEQ ID NO: 2336 - DNA, 16 bp, Artificial sequence
  Synthetic oligonucleotide
aatgtaagtgataggt

SEQ ID NO: 2337 - DNA, 16 bp, Artificial sequence
  Synthetic oligonucleotide
tactaggtgcttgttg

SEQ ID NO: 2338 - DNA, 16 bp, Artificial sequence
  Synthetic oligonucleotide
gtggacacttttagag

SEQ ID NO: 2339 - DNA, 16 bp, Artificial sequence
  Synthetic oligonucleotide
agcagaacgaggtaaa

SEQ ID NO: 2340 - DNA, 16 bp, Artificial sequence
  Synthetic oligonucleotide
aaacacagtctgctgc

SEQ ID NO: 2341 - DNA, 16 bp, Artificial sequence
  Synthetic oligonucleotide
aggtaagggccccgtg

SEQ ID NO: 2342 - DNA, 16 bp, Artificial sequence
  Synthetic oligonucleotide
aaaggaggtagtggcc

SEQ ID NO: 2343 - DNA, 16 bp, Artificial sequence
  Synthetic oligonucleotide
taaattctagtttgcc

SEQ ID NO: 2344 - DNA, 16 bp, Artificial sequence
  Synthetic oligonucleotide
cgctcaggactcaggg

SEQ ID NO: 2345 - DNA, 16 bp, Artificial sequence
  Synthetic oligonucleotide
ggtaacaatactgtaa

SEQ ID NO: 2346 - DNA, 16 bp, Artificial sequence
  Synthetic oligonucleotide
tggcggagcatcaaca

SEQ ID NO: 2347 - DNA, 16 bp, Artificial sequence
  Synthetic oligonucleotide
gaacggaagtttacac

SEQ ID NO: 2348 - DNA, 16 bp, Artificial sequence
  Synthetic oligonucleotide
tccacctgcatcgaga

SEQ ID NO: 2349 - DNA, 16 bp, Artificial sequence
  Synthetic oligonucleotide
ttgaagcaacacggga

SEQ ID NO: 2350 - DNA, 16 bp, Artificial sequence
  Synthetic oligonucleotide
catagcattatctacc

SEQ ID NO: 2351 - DNA, 16 bp, Artificial sequence
  Synthetic oligonucleotide
ttaagctaaactccta

SEQ ID NO: 2352 - DNA, 16 bp, Artificial sequence
  Synthetic oligonucleotide
gcatctaaggcaagct

SEQ ID NO: 2353 - DNA, 16 bp, Artificial sequence
  Synthetic oligonucleotide
agccaaggaggcgggc

SEQ ID NO: 2354 - DNA, 16 bp, Artificial sequence
  Synthetic oligonucleotide
cgccaggccggctagg

SEQ ID NO: 2355 - DNA, 16 bp, Artificial sequence
  Synthetic oligonucleotide
gcggaggacctcgcct

SEQ ID NO: 2356 - DNA, 16 bp, Artificial sequence
  Synthetic oligonucleotide
ccccggaagaaggcac

SEQ ID NO: 2357 - DNA, 16 bp, Artificial sequence
  Synthetic oligonucleotide
acgaacgcgcaaaacc

SEQ ID NO: 2358 - DNA, 16 bp, Artificial sequence
  Synthetic oligonucleotide
agccgccggcacaggc

SEQ ID NO: 2359 - DNA, 16 bp, Artificial sequence
  Synthetic oligonucleotide
ggtaaactgccttagg

SEQ ID NO: 2360 - DNA, 16 bp, Artificial sequence
  Synthetic oligonucleotide
tgaaagaccccagcta

SEQ ID NO: 2361 - DNA, 16 bp, Artificial sequence
  Synthetic oligonucleotide
ctagaaagtgatgctc

SEQ ID NO: 2362 - DNA, 16 bp, Artificial sequence
  Synthetic oligonucleotide
cactaaagactattag

SEQ ID NO: 2363 - DNA, 16 bp, Artificial sequence
  Synthetic oligonucleotide
ttgtacaggacaggta

SEQ ID NO: 2364 - DNA, 16 bp, Artificial sequence
  Synthetic oligonucleotide
atccacaccaatggca

SEQ ID NO: 2365 - DNA, 16 bp, Artificial sequence
  Synthetic oligonucleotide
agggaatcccttatta

SEQ ID NO: 2366 - DNA, 16 bp, Artificial sequence
  Synthetic oligonucleotide
ggacagaccaggattc

SEQ ID NO: 2367 - DNA, 16 bp, Artificial sequence
  Synthetic oligonucleotide
tcaataatctcccagc

SEQ ID NO: 2368 - DNA, 16 bp, Artificial sequence
  Synthetic oligonucleotide
gcctgagttaccgcat

SEQ ID NO: 2369 - DNA, 16 bp, Artificial sequence
  Synthetic oligonucleotide
taccatattggaaacc

SEQ ID NO: 2370 - DNA, 16 bp, Artificial sequence
  Synthetic oligonucleotide
tttactgttaccgatg

SEQ ID NO: 2371 - DNA, 16 bp, Artificial sequence
  Synthetic oligonucleotide
gagaaacgagccagtg

SEQ ID NO: 2372 - DNA, 16 bp, Artificial sequence
  Synthetic oligonucleotide
atctactccagacccc

SEQ ID NO: 2373 - DNA, 16 bp, Artificial sequence
  Synthetic oligonucleotide
ggctcaacctggaagg

SEQ ID NO: 2374 - DNA, 16 bp, Artificial sequence
  Synthetic oligonucleotide
cctagaggtgccttct

SEQ ID NO: 2375 - DNA, 16 bp, Artificial sequence
  Synthetic oligonucleotide
tactcacgagcacctc

SEQ ID NO: 2376 - DNA, 16 bp, Artificial sequence
  Synthetic oligonucleotide
tgcttcaacacactgt

SEQ ID NO: 2377 - DNA, 16 bp, Artificial sequence
  Synthetic oligonucleotide
taaacaagatgaatcc

SEQ ID NO: 2378 - DNA, 16 bp, Artificial sequence
  Synthetic oligonucleotide
aagaagcaagtcggtc

SEQ ID NO: 2379 - DNA, 16 bp, Artificial sequence
  Synthetic oligonucleotide
gtctaaaccagcatat

SEQ ID NO: 2380 - DNA, 16 bp, Artificial sequence
  Synthetic oligonucleotide
cagataacgaggtgcc

SEQ ID NO: 2381 - DNA, 16 bp, Artificial sequence
  Synthetic oligonucleotide
gaaaagagccgccaca

SEQ ID NO: 2382 - DNA, 16 bp, Artificial sequence
  Synthetic oligonucleotide
gctgaattgtcatgaa

SEQ ID NO: 2383 - DNA, 16 bp, Artificial sequence
  Synthetic oligonucleotide
tggcaccaaggtccag

SEQ ID NO: 2384 - DNA, 16 bp, Artificial sequence
  Synthetic oligonucleotide
tccttaattatgcaga

SEQ ID NO: 2385 - DNA, 16 bp, Artificial sequence
  Synthetic oligonucleotide
attcacactgccgtga

SEQ ID NO: 2386 - DNA, 16 bp, Artificial sequence
  Synthetic oligonucleotide
aaacgagttgacacag

SEQ ID NO: 2387 - DNA, 16 bp, Artificial sequence
  Synthetic oligonucleotide
caatttatgccatgga

SEQ ID NO: 2388 - DNA, 16 bp, Artificial sequence
  Synthetic oligonucleotide
tagcatgtatgcattc

SEQ ID NO: 2389 - DNA, 16 bp, Artificial sequence
  Synthetic oligonucleotide
agccactatggtagga

SEQ ID NO: 2390 - DNA, 16 bp, Artificial sequence
  Synthetic oligonucleotide
atcttaacctggagaa

SEQ ID NO: 2391 - DNA, 16 bp, Artificial sequence
  Synthetic oligonucleotide
tagagaacattacgag

SEQ ID NO: 2392 - DNA, 16 bp, Artificial sequence
  Synthetic oligonucleotide
ctagaacatgatgaga

SEQ ID NO: 2393 - DNA, 16 bp, Artificial sequence
  Synthetic oligonucleotide
ttatactgtctggtta

SEQ ID NO: 2394 - DNA, 16 bp, Artificial sequence
  Synthetic oligonucleotide
tttcaaatcgactgcc

SEQ ID NO: 2395 - DNA, 16 bp, Artificial sequence
  Synthetic oligonucleotide
tgcaactggctcacta

SEQ ID NO: 2396 - DNA, 16 bp, Artificial sequence
  Synthetic oligonucleotide
tcatatggctaaacct

SEQ ID NO: 2397 - DNA, 16 bp, Artificial sequence
  Synthetic oligonucleotide
caaaaacttgggtcac

SEQ ID NO: 2398 - DNA, 16 bp, Artificial sequence
  Synthetic oligonucleotide
gtaacttgacttgaga

SEQ ID NO: 2399 - DNA, 16 bp, Artificial sequence
  Synthetic oligonucleotide
agctgagctgatcatc

SEQ ID NO: 2400 - DNA, 16 bp, Artificial sequence
  Synthetic oligonucleotide
ccttgaagagcgcggc

SEQ ID NO: 2401 - DNA, 16 bp, Artificial sequence
  Synthetic oligonucleotide
gagcgaagggtaaggc

SEQ ID NO: 2402 - DNA, 16 bp, Artificial sequence
  Synthetic oligonucleotide
tcccagtagatcctgc

SEQ ID NO: 2403 - DNA, 16 bp, Artificial sequence
  Synthetic oligonucleotide
aatatagttgtctggc

SEQ ID NO: 2404 - DNA, 16 bp, Artificial sequence
  Synthetic oligonucleotide
gggcagtcaattggac

SEQ ID NO: 2405 - DNA, 16 bp, Artificial sequence
  Synthetic oligonucleotide
gatcatcaatgatggc

SEQ ID NO: 2406 - DNA, 16 bp, Artificial sequence
  Synthetic oligonucleotide
agtcatcactctagtc

SEQ ID NO: 2407 - DNA, 16 bp, Artificial sequence
  Synthetic oligonucleotide
ggcacggcttcagtca

SEQ ID NO: 2408 - DNA, 16 bp, Artificial sequence
  Synthetic oligonucleotide
caaaaatgtcccatcc

SEQ ID NO: 2409 - DNA, 16 bp, Artificial sequence
  Synthetic oligonucleotide
ttctttatgcgaagaa

SEQ ID NO: 2410 - DNA, 16 bp, Artificial sequence
  Synthetic oligonucleotide
ctttagtgtcgccatg

SEQ ID NO: 2411 - DNA, 16 bp, Artificial sequence
  Synthetic oligonucleotide
tggaggtctttgggat

SEQ ID NO: 2412 - DNA, 16 bp, Artificial sequence
  Synthetic oligonucleotide
gtctactgctgtactt

SEQ ID NO: 2413 - DNA, 16 bp, Artificial sequence
  Synthetic oligonucleotide
ttactaggtgcttgtt

SEQ ID NO: 2414 - DNA, 16 bp, Artificial sequence
  Synthetic oligonucleotide
ttgtggacacttttag

SEQ ID NO: 2415 - DNA, 16 bp, Artificial sequence
  Synthetic oligonucleotide
gagcagaacgaggtaa

SEQ ID NO: 2416 - DNA, 16 bp, Artificial sequence
  Synthetic oligonucleotide
cgaaacacagtctgct

SEQ ID NO: 2417 - DNA, 16 bp, Artificial sequence
  Synthetic oligonucleotide
tcacaggtaagggccc

SEQ ID NO: 2418 - DNA, 16 bp, Artificial sequence
  Synthetic oligonucleotide
gaaaggaggtagtggc

SEQ ID NO: 2419 - DNA, 16 bp, Artificial sequence
  Synthetic oligonucleotide
ctaaattctagtttgc

SEQ ID NO: 2420 - DNA, 16 bp, Artificial sequence
  Synthetic oligonucleotide
gactaactctcctgtt

SEQ ID NO: 2421 - DNA, 16 bp, Artificial sequence
  Synthetic oligonucleotide
tggtaacaatactgta

SEQ ID NO: 2422 - DNA, 16 bp, Artificial sequence
  Synthetic oligonucleotide
ggccttcctggcggag

SEQ ID NO: 2423 - DNA, 16 bp, Artificial sequence
  Synthetic oligonucleotide
atgaacggaagtttac

SEQ ID NO: 2424 - DNA, 16 bp, Artificial sequence
  Synthetic oligonucleotide
tctcaaggagatccac

SEQ ID NO: 2425 - DNA, 16 bp, Artificial sequence
  Synthetic oligonucleotide
tttgaagcaacacggg

SEQ ID NO: 2426 - DNA, 16 bp, Artificial sequence
  Synthetic oligonucleotide
gcatagcattatctac

SEQ ID NO: 2427 - DNA, 16 bp, Artificial sequence
  Synthetic oligonucleotide
acttaagctaaactcc

SEQ ID NO: 2428 - DNA, 16 bp, Artificial sequence
  Synthetic oligonucleotide
agcatctaaggcaagc

SEQ ID NO: 2429 - DNA, 16 bp, Artificial sequence
  Synthetic oligonucleotide
caggagcgcggagggc

SEQ ID NO: 2430 - DNA, 16 bp, Artificial sequence
  Synthetic oligonucleotide
acgacagctgcggagc

SEQ ID NO: 2431 - DNA, 16 bp, Artificial sequence
  Synthetic oligonucleotide
gcgcggaggacctcgc

SEQ ID NO: 2432 - DNA, 16 bp, Artificial sequence
  Synthetic oligonucleotide
gaccacgaggccccgg

SEQ ID NO: 2433 - DNA, 16 bp, Artificial sequence
  Synthetic oligonucleotide
ggacgaacgcgcaaaa

SEQ ID NO: 2434 - DNA, 16 bp, Artificial sequence
  Synthetic oligonucleotide
aaacagccgccggcac

SEQ ID NO: 2435 - DNA, 16 bp, Artificial sequence
  Synthetic oligonucleotide
tcccggaggaagtccc

SEQ ID NO: 2436 - DNA, 16 bp, Artificial sequence
  Synthetic oligonucleotide
gtaaactgaaagaccc

SEQ ID NO: 2437 - DNA, 16 bp, Artificial sequence
  Synthetic oligonucleotide
cataactcaggcaagg

SEQ ID NO: 2438 - DNA, 16 bp, Artificial sequence
  Synthetic oligonucleotide
actcactaaagactat

SEQ ID NO: 2439 - DNA, 16 bp, Artificial sequence
  Synthetic oligonucleotide
ctacaaggtctgagtt

SEQ ID NO: 2440 - DNA, 16 bp, Artificial sequence
  Synthetic oligonucleotide
acttaaaatccacacc

SEQ ID NO: 2441 - DNA, 16 bp, Artificial sequence
  Synthetic oligonucleotide
tttatgtaaagcttcg

SEQ ID NO: 2442 - DNA, 16 bp, Artificial sequence
  Synthetic oligonucleotide
cctcagggaatccctt

SEQ ID NO: 2443 - DNA, 16 bp, Artificial sequence
  Synthetic oligonucleotide
ggaaagagctttggtg

SEQ ID NO: 2444 - DNA, 16 bp, Artificial sequence
  Synthetic oligonucleotide
ctcaataatctcccag

SEQ ID NO: 2445 - DNA, 16 bp, Artificial sequence
  Synthetic oligonucleotide
gtaactaactcaaaag

SEQ ID NO: 2446 - DNA, 16 bp, Artificial sequence
  Synthetic oligonucleotide
cactaccatattggaa

SEQ ID NO: 2447 - DNA, 16 bp, Artificial sequence
  Synthetic oligonucleotide
atttactgttaccgat

SEQ ID NO: 2448 - DNA, 16 bp, Artificial sequence
  Synthetic oligonucleotide
ggagaaacgagccagt

SEQ ID NO: 2449 - DNA, 16 bp, Artificial sequence
  Synthetic oligonucleotide
ctacatctactccaga

SEQ ID NO: 2450 - DNA, 16 bp, Artificial sequence
  Synthetic oligonucleotide
ttatttgtggctcaac

SEQ ID NO: 2451 - DNA, 16 bp, Artificial sequence
  Synthetic oligonucleotide
agcctagaggtgcctt

SEQ ID NO: 2452 - DNA, 16 bp, Artificial sequence
  Synthetic oligonucleotide
gggcatcctcagttac

SEQ ID NO: 2453 - DNA, 16 bp, Artificial sequence
  Synthetic oligonucleotide
acccacatcactgtct

SEQ ID NO: 2454 - DNA, 16 bp, Artificial sequence
  Synthetic oligonucleotide
ctaaaactgcgctctc

SEQ ID NO: 2455 - DNA, 16 bp, Artificial sequence
  Synthetic oligonucleotide
agaaagaagcaagtcg

SEQ ID NO: 2456 - DNA, 16 bp, Artificial sequence
  Synthetic oligonucleotide
ttaatctgtctaaacc

SEQ ID NO: 2457 - DNA, 16 bp, Artificial sequence
  Synthetic oligonucleotide
acagataacgaggtgc

SEQ ID NO: 2458 - DNA, 16 bp, Artificial sequence
  Synthetic oligonucleotide
ttccaacctttatgat

SEQ ID NO: 2459 - DNA, 16 bp, Artificial sequence
  Synthetic oligonucleotide
gttcgctgaattgtca

SEQ ID NO: 2460 - DNA, 16 bp, Artificial sequence
  Synthetic oligonucleotide
tacaaaaacttgggtc

SEQ ID NO: 2461 - DNA, 16 bp, Artificial sequence
  Synthetic oligonucleotide
tagaaagccctcacct

SEQ ID NO: 2462 - DNA, 16 bp, Artificial sequence
  Synthetic oligonucleotide
gggaatccttaattat

SEQ ID NO: 2463 - DNA, 16 bp, Artificial sequence
  Synthetic oligonucleotide
tacattcacactgccg

SEQ ID NO: 2464 - DNA, 16 bp, Artificial sequence
  Synthetic oligonucleotide
agaaacgagttgacac

SEQ ID NO: 2465 - DNA, 16 bp, Artificial sequence
  Synthetic oligonucleotide
cagtaacttgacttga

SEQ ID NO: 2466 - DNA, 16 bp, Artificial sequence
  Synthetic oligonucleotide
ccaatttatgccatgg

SEQ ID NO: 2467 - DNA, 16 bp, Artificial sequence
  Synthetic oligonucleotide
gaacatctcagataca

SEQ ID NO: 2468 - DNA, 16 bp, Artificial sequence
  Synthetic oligonucleotide
gaacaggaagccacta

SEQ ID NO: 2469 - DNA, 16 bp, Artificial sequence
  Synthetic oligonucleotide
tcttacagcaatctta

SEQ ID NO: 2470 - DNA, 16 bp, Artificial sequence
  Synthetic oligonucleotide
ctatgctagagaacat

SEQ ID NO: 2471 - DNA, 16 bp, Artificial sequence
  Synthetic oligonucleotide
gctagaacatgatgag

SEQ ID NO: 2472 - DNA, 16 bp, Artificial sequence
  Synthetic oligonucleotide
gatagctgagctgatc

SEQ ID NO: 2473 - DNA, 16 bp, Artificial sequence
  Synthetic oligonucleotide
atttatactgtctggt

SEQ ID NO: 2474 - DNA, 16 bp, Artificial sequence
  Synthetic oligonucleotide
tgttactttcaaatcg

SEQ ID NO: 2475 - DNA, 16 bp, Artificial sequence
  Synthetic oligonucleotide
ctgcaactggctcact

SEQ ID NO: 2476 - DNA, 16 bp, Artificial sequence
  Synthetic oligonucleotide
gccttgaagagcgcgg

SEQ ID NO: 2477 - DNA, 16 bp, Artificial sequence
  Synthetic oligonucleotide
tgtgaacctgctgggc

SEQ ID NO: 2478 - DNA, 16 bp, Artificial sequence
  Synthetic oligonucleotide
caaagagcttgcaggt

SEQ ID NO: 2479 - DNA, 16 bp, Artificial sequence
  Synthetic oligonucleotide
taatatagttgtctgg

SEQ ID NO: 2480 - DNA, 16 bp, Artificial sequence
  Synthetic oligonucleotide
gtaagagggcagtcaa

SEQ ID NO: 2481 - DNA, 16 bp, Artificial sequence
  Synthetic oligonucleotide
tcacagtgatcatcaa

SEQ ID NO: 2482 - DNA, 16 bp, Artificial sequence
  Synthetic oligonucleotide
tacaagcagtcatcac

SEQ ID NO: 2483 - DNA, 16 bp, Artificial sequence
  Synthetic oligonucleotide
aggcacggcttcagtc

SEQ ID NO: 2484 - DNA, 16 bp, Artificial sequence
  Synthetic oligonucleotide
tagattgtaggacaga

SEQ ID NO: 2485 - DNA, 16 bp, Artificial sequence
  Synthetic oligonucleotide
cttctttatgcgaaga

SEQ ID NO: 2486 - DNA, 16 bp, Artificial sequence
  Synthetic oligonucleotide
cctttagtgtcgccat

SEQ ID NO: 2487 - DNA, 16 bp, Artificial sequence
  Synthetic oligonucleotide
agtggaggtctttggg

SEQ ID NO: 2488 - DNA, 16 bp, Artificial sequence
  Synthetic oligonucleotide
ccccagtctactgctg

SEQ ID NO: 2489 - DNA, 16 bp, Artificial sequence
  Synthetic oligonucleotide
cttactaggtgcttgt

SEQ ID NO: 2490 - DNA, 16 bp, Artificial sequence
  Synthetic oligonucleotide
aaacaccccttcttgt

SEQ ID NO: 2491 - DNA, 16 bp, Artificial sequence
  Synthetic oligonucleotide
tctgagcagaacgagg

SEQ ID NO: 2492 - DNA, 16 bp, Artificial sequence
  Synthetic oligonucleotide
acgaaacacagtctgc

SEQ ID NO: 2493 - DNA, 16 bp, Artificial sequence
  Synthetic oligonucleotide
ggtcacaggtaagggc

SEQ ID NO: 2494 - DNA, 16 bp, Artificial sequence
  Synthetic oligonucleotide
tcataccctggatcac

SEQ ID NO: 2495 - DNA, 16 bp, Artificial sequence
  Synthetic oligonucleotide
gtccactgagtacaaa

SEQ ID NO: 2496 - DNA, 16 bp, Artificial sequence
  Synthetic oligonucleotide
gcgactaactctcctg

SEQ ID NO: 2497 - DNA, 16 bp, Artificial sequence
  Synthetic oligonucleotide
aatacctacctgccct

SEQ ID NO: 2498 - DNA, 16 bp, Artificial sequence
  Synthetic oligonucleotide
cacaagtggccttcct

SEQ ID NO: 2499 - DNA, 16 bp, Artificial sequence
  Synthetic oligonucleotide
caatgaacggaagttt

SEQ ID NO: 2500 - DNA, 16 bp, Artificial sequence
  Synthetic oligonucleotide
ctatcaggatctcaag

SEQ ID NO: 2501 - DNA, 16 bp, Artificial sequence
  Synthetic oligonucleotide
tgttaagtcccatctg

SEQ ID NO: 2502 - DNA, 16 bp, Artificial sequence
  Synthetic oligonucleotide
agcatagcattatcta

SEQ ID NO: 2503 - DNA, 16 bp, Artificial sequence
  Synthetic oligonucleotide
gacttaagctaaactc

SEQ ID NO: 2504 - DNA, 16 bp, Artificial sequence
  Synthetic oligonucleotide
cagcatctaaggcaag

SEQ ID NO: 2505 - DNA, 16 bp, Artificial sequence
  Synthetic oligonucleotide
gacgacagctgcggag

SEQ ID NO: 2506 - DNA, 16 bp, Artificial sequence
  Synthetic oligonucleotide
acgcgcggaggacctc

SEQ ID NO: 2507 - DNA, 16 bp, Artificial sequence
  Synthetic oligonucleotide
agtgaccacgaggccc

SEQ ID NO: 2508 - DNA, 16 bp, Artificial sequence
  Synthetic oligonucleotide
cggacgaacgcgcaaa

SEQ ID NO: 2509 - DNA, 16 bp, Artificial sequence
  Synthetic oligonucleotide
gaaaacagccgccggc

SEQ ID NO: 2510 - DNA, 16 bp, Artificial sequence
  Synthetic oligonucleotide
caaattcccggaggaa

SEQ ID NO: 2511 - DNA, 16 bp, Artificial sequence
  Synthetic oligonucleotide
cgtaaactgaaagacc

SEQ ID NO: 2512 - DNA, 16 bp, Artificial sequence
  Synthetic oligonucleotide
acataactcaggcaag

SEQ ID NO: 2513 - DNA, 16 bp, Artificial sequence
  Synthetic oligonucleotide
caaaatagtcactcac

SEQ ID NO: 2514 - DNA, 16 bp, Artificial sequence
  Synthetic oligonucleotide
tctacaaggtctgagt

SEQ ID NO: 2515 - DNA, 16 bp, Artificial sequence
  Synthetic oligonucleotide
ccaacttaaaatccac

SEQ ID NO: 2516 - DNA, 16 bp, Artificial sequence
  Synthetic oligonucleotide
gatacttgtactgttt

SEQ ID NO: 2517 - DNA, 16 bp, Artificial sequence
  Synthetic oligonucleotide
aagaagcactggcatt

SEQ ID NO: 2518 - DNA, 16 bp, Artificial sequence
  Synthetic oligonucleotide
gggaaagagctttggt

SEQ ID NO: 2519 - DNA, 16 bp, Artificial sequence
  Synthetic oligonucleotide
aaatataccagctcaa

SEQ ID NO: 2520 - DNA, 16 bp, Artificial sequence
  Synthetic oligonucleotide
ccaaagggttcagtgt

SEQ ID NO: 2521 - DNA, 16 bp, Artificial sequence
  Synthetic oligonucleotide
ctccactaccatattg

SEQ ID NO: 2522 - DNA, 16 bp, Artificial sequence
  Synthetic oligonucleotide
catttactgttaccga

SEQ ID NO: 2523 - DNA, 16 bp, Artificial sequence
  Synthetic oligonucleotide
tggagaaacgagccag

SEQ ID NO: 2524 - DNA, 16 bp, Artificial sequence
  Synthetic oligonucleotide
gtctacatctactcca

SEQ ID NO: 2525 - DNA, 16 bp, Artificial sequence
  Synthetic oligonucleotide
cttatttgtggctcaa

SEQ ID NO: 2526 - DNA, 16 bp, Artificial sequence
  Synthetic oligonucleotide
accttaagctatttgg

SEQ ID NO: 2527 - DNA, 16 bp, Artificial sequence
  Synthetic oligonucleotide
cccaaagggcatcctc

SEQ ID NO: 2528 - DNA, 16 bp, Artificial sequence
  Synthetic oligonucleotide
acttaacccacatcac

SEQ ID NO: 2529 - DNA, 16 bp, Artificial sequence
  Synthetic oligonucleotide
ggctttgtgtttaagt

SEQ ID NO: 2530 - DNA, 16 bp, Artificial sequence
  Synthetic oligonucleotide
taacggtgtttcagaa

SEQ ID NO: 2531 - DNA, 16 bp, Artificial sequence
  Synthetic oligonucleotide
ccatttaatctgtcta

SEQ ID NO: 2532 - DNA, 16 bp, Artificial sequence
  Synthetic oligonucleotide
aacagataacgaggtg

SEQ ID NO: 2533 - DNA, 16 bp, Artificial sequence
  Synthetic oligonucleotide
caatatgcttccaacc

SEQ ID NO: 2534 - DNA, 16 bp, Artificial sequence
  Synthetic oligonucleotide
agccagaggttcgctg

SEQ ID NO: 2535 - DNA, 16 bp, Artificial sequence
  Synthetic oligonucleotide
gcttacaaaaacttgg

SEQ ID NO: 2536 - DNA, 16 bp, Artificial sequence
  Synthetic oligonucleotide
ttagaaagccctcacc

SEQ ID NO: 2537 - DNA, 16 bp, Artificial sequence
  Synthetic oligonucleotide
tgggaatccttaatta

SEQ ID NO: 2538 - DNA, 16 bp, Artificial sequence
  Synthetic oligonucleotide
aagaaacgagttgaca

SEQ ID NO: 2539 - DNA, 16 bp, Artificial sequence
  Synthetic oligonucleotide
tggaacagtaacttga

SEQ ID NO: 2540 - DNA, 16 bp, Artificial sequence
  Synthetic oligonucleotide
accaatttatgccatg

SEQ ID NO: 2541 - DNA, 16 bp, Artificial sequence
  Synthetic oligonucleotide
tgtgaacatctcagat

SEQ ID NO: 2542 - DNA, 16 bp, Artificial sequence
  Synthetic oligonucleotide
ggcctttacaaagaac

SEQ ID NO: 2543 - DNA, 16 bp, Artificial sequence
  Synthetic oligonucleotide
tagcattcttacagca

SEQ ID NO: 2544 - DNA, 16 bp, Artificial sequence
  Synthetic oligonucleotide
gttgaacccatcttga

SEQ ID NO: 2545 - DNA, 16 bp, Artificial sequence
  Synthetic oligonucleotide
agctagaacatgatga

SEQ ID NO: 2546 - DNA, 16 bp, Artificial sequence
  Synthetic oligonucleotide
tgatagctgagctgat

SEQ ID NO: 2547 - DNA, 16 bp, Artificial sequence
  Synthetic oligonucleotide
agctaactggcctcaa

SEQ ID NO: 2548 - DNA, 16 bp, Artificial sequence
  Synthetic oligonucleotide
gggttaaagatgttac

SEQ ID NO: 2549 - DNA, 16 bp, Artificial sequence
  Synthetic oligonucleotide
agatatcctgcaactg

SEQ ID NO: 2550 - DNA, 16 bp, Artificial sequence
  Synthetic oligonucleotide
tcgcaggagcgcggag

SEQ ID NO: 2551 - DNA, 16 bp, Artificial sequence
  Synthetic oligonucleotide
atacattcacactgcc

SEQ ID NO: 2552 - DNA, 16 bp, Artificial sequence
  Synthetic oligonucleotide
gcccaagccttgaaga

SEQ ID NO: 2553 - DNA, 16 bp, Artificial sequence
  Synthetic oligonucleotide
atgtagttgtgaacct

SEQ ID NO: 2554 - DNA, 16 bp, Artificial sequence
  Synthetic oligonucleotide
gtcaaagagcttgcag

SEQ ID NO: 2555 - DNA, 16 bp, Artificial sequence
  Synthetic oligonucleotide
ataatatagttgtctg

SEQ ID NO: 2556 - DNA, 16 bp, Artificial sequence
  Synthetic oligonucleotide
agtaagagggcagtca

SEQ ID NO: 2557 - DNA, 16 bp, Artificial sequence
  Synthetic oligonucleotide
ggtcaattttcacagt

SEQ ID NO: 2558 - DNA, 16 bp, Artificial sequence
  Synthetic oligonucleotide
ctacaagcagtcatca

SEQ ID NO: 2559 - DNA, 16 bp, Artificial sequence
  Synthetic oligonucleotide
acaggcacggcttcag

SEQ ID NO: 2560 - DNA, 16 bp, Artificial sequence
  Synthetic oligonucleotide
actagattgtaggaca

SEQ ID NO: 2561 - DNA, 16 bp, Artificial sequence
  Synthetic oligonucleotide
gttcaagtattaagat

SEQ ID NO: 2562 - DNA, 16 bp, Artificial sequence
  Synthetic oligonucleotide
tcctttagtgtcgcca

SEQ ID NO: 2563 - DNA, 16 bp, Artificial sequence
  Synthetic oligonucleotide
aagtggaggtctttgg

SEQ ID NO: 2564 - DNA, 16 bp, Artificial sequence
  Synthetic oligonucleotide
tagggatacagcaggc

SEQ ID NO: 2565 - DNA, 16 bp, Artificial sequence
  Synthetic oligonucleotide
ataaacaccccttctt

SEQ ID NO: 2566 - DNA, 16 bp, Artificial sequence
  Synthetic oligonucleotide
ggcctctgagcagaac

SEQ ID NO: 2567 - DNA, 16 bp, Artificial sequence
  Synthetic oligonucleotide
cacgaaacacagtctg

SEQ ID NO: 2568 - DNA, 16 bp, Artificial sequence
  Synthetic oligonucleotide
aaagagggtcacaggt

SEQ ID NO: 2569 - DNA, 16 bp, Artificial sequence
  Synthetic oligonucleotide
ggtcataccctggatc

SEQ ID NO: 2570 - DNA, 16 bp, Artificial sequence
  Synthetic oligonucleotide
ttcaacagcactgtcc

SEQ ID NO: 2571 - DNA, 16 bp, Artificial sequence
  Synthetic oligonucleotide
tgtagggcgactaact

SEQ ID NO: 2572 - DNA, 16 bp, Artificial sequence
  Synthetic oligonucleotide
taatacctacctgccc

SEQ ID NO: 2573 - DNA, 16 bp, Artificial sequence
  Synthetic oligonucleotide
acacacaagtggcctt

SEQ ID NO: 2574 - DNA, 16 bp, Artificial sequence
  Synthetic oligonucleotide
gcaatgaacggaagtt

SEQ ID NO: 2575 - DNA, 16 bp, Artificial sequence
  Synthetic oligonucleotide
gctatcaggatctcaa

SEQ ID NO: 2576 - DNA, 16 bp, Artificial sequence
  Synthetic oligonucleotide
ctgttaagtcccatct

SEQ ID NO: 2577 - DNA, 16 bp, Artificial sequence
  Synthetic oligonucleotide
cagcatagcattatct

SEQ ID NO: 2578 - DNA, 16 bp, Artificial sequence
  Synthetic oligonucleotide
acgacttaagctaaac

SEQ ID NO: 2579 - DNA, 16 bp, Artificial sequence
  Synthetic oligonucleotide
tttacagcatctaagg

SEQ ID NO: 2580 - DNA, 16 bp, Artificial sequence
  Synthetic oligonucleotide
ggcgaccccgtcgcag

SEQ ID NO: 2581 - DNA, 16 bp, Artificial sequence
  Synthetic oligonucleotide
gggcgacgacagctgc

SEQ ID NO: 2582 - DNA, 16 bp, Artificial sequence
  Synthetic oligonucleotide
ccacgcgcggaggacc

SEQ ID NO: 2583 - DNA, 16 bp, Artificial sequence
  Synthetic oligonucleotide
cgccagtgaccacgag

SEQ ID NO: 2584 - DNA, 16 bp, Artificial sequence
  Synthetic oligonucleotide
cacggacgaacgcgca

SEQ ID NO: 2585 - DNA, 16 bp, Artificial sequence
  Synthetic oligonucleotide
accaaattcccggagg

SEQ ID NO: 2586 - DNA, 16 bp, Artificial sequence
  Synthetic oligonucleotide
gcataggtccttcaga

SEQ ID NO: 2587 - DNA, 16 bp, Artificial sequence
  Synthetic oligonucleotide
cacataactcaggcaa

SEQ ID NO: 2588 - DNA, 16 bp, Artificial sequence
  Synthetic oligonucleotide
tgcaaaatagtcactc

SEQ ID NO: 2589 - DNA, 16 bp, Artificial sequence
  Synthetic oligonucleotide
ttctacaaggtctgag

SEQ ID NO: 2590 - DNA, 16 bp, Artificial sequence
  Synthetic oligonucleotide
gcggacacgcccgacc

SEQ ID NO: 2591 - DNA, 16 bp, Artificial sequence
  Synthetic oligonucleotide
ggagatacttgtactg

SEQ ID NO: 2592 - DNA, 16 bp, Artificial sequence
  Synthetic oligonucleotide
agataagaagcactgg

SEQ ID NO: 2593 - DNA, 16 bp, Artificial sequence
  Synthetic oligonucleotide
gaaatataccagctca

SEQ ID NO: 2594 - DNA, 16 bp, Artificial sequence
  Synthetic oligonucleotide
ggccaaattgcaaagg

SEQ ID NO: 2595 - DNA, 16 bp, Artificial sequence
  Synthetic oligonucleotide
tagttttatgttagcc

SEQ ID NO: 2596 - DNA, 16 bp, Artificial sequence
  Synthetic oligonucleotide
ttcatttactgttacc

SEQ ID NO: 2597 - DNA, 16 bp, Artificial sequence
  Synthetic oligonucleotide
gctgatggagaaacga

SEQ ID NO: 2598 - DNA, 16 bp, Artificial sequence
  Synthetic oligonucleotide
taaatcaccctggtca

SEQ ID NO: 2599 - DNA, 16 bp, Artificial sequence
  Synthetic oligonucleotide
gtagaggaggaggact

SEQ ID NO: 2600 - DNA, 16 bp, Artificial sequence
  Synthetic oligonucleotide
tccaaaccttaagcta

SEQ ID NO: 2601 - DNA, 16 bp, Artificial sequence
  Synthetic oligonucleotide
agccttcctgctcaga

SEQ ID NO: 2602 - DNA, 16 bp, Artificial sequence
  Synthetic oligonucleotide
gacttaacccacatca

SEQ ID NO: 2603 - DNA, 16 bp, Artificial sequence
  Synthetic oligonucleotide
tcccactgggctttgt

SEQ ID NO: 2604 - DNA, 16 bp, Artificial sequence
  Synthetic oligonucleotide
ataacggtgtttcaga

SEQ ID NO: 2605 - DNA, 16 bp, Artificial sequence
  Synthetic oligonucleotide
cccatttaatctgtct

SEQ ID NO: 2606 - DNA, 16 bp, Artificial sequence
  Synthetic oligonucleotide
ctaacagataacgagg

SEQ ID NO: 2607 - DNA, 16 bp, Artificial sequence
  Synthetic oligonucleotide
gttaacaatatgcttc

SEQ ID NO: 2608 - DNA, 16 bp, Artificial sequence
  Synthetic oligonucleotide
agccagccagaggttc

SEQ ID NO: 2609 - DNA, 16 bp, Artificial sequence
  Synthetic oligonucleotide
gaaaatctggatgagc

SEQ ID NO: 2610 - DNA, 16 bp, Artificial sequence
  Synthetic oligonucleotide
agccagtgccagttcc

SEQ ID NO: 2611 - DNA, 16 bp, Artificial sequence
  Synthetic oligonucleotide
agataacatgagagtg

SEQ ID NO: 2612 - DNA, 16 bp, Artificial sequence
  Synthetic oligonucleotide
aatgacttagtcagaa

SEQ ID NO: 2613 - DNA, 16 bp, Artificial sequence
  Synthetic oligonucleotide
gcaaaagaaacgagtt

SEQ ID NO: 2614 - DNA, 16 bp, Artificial sequence
  Synthetic oligonucleotide
gatggaacagtaactt

SEQ ID NO: 2615 - DNA, 16 bp, Artificial sequence
  Synthetic oligonucleotide
acgcaatggcaaaaga

SEQ ID NO: 2616 - DNA, 16 bp, Artificial sequence
  Synthetic oligonucleotide
tcttactccgctgagt

SEQ ID NO: 2617 - DNA, 16 bp, Artificial sequence
  Synthetic oligonucleotide
ttccaggtcatttgac

SEQ ID NO: 2618 - DNA, 16 bp, Artificial sequence
  Synthetic oligonucleotide
ctagatagcattctta

SEQ ID NO: 2619 - DNA, 16 bp, Artificial sequence
  Synthetic oligonucleotide
ccacagttgaacccat

SEQ ID NO: 2620 - DNA, 16 bp, Artificial sequence
  Synthetic oligonucleotide
tcagagctagaacatg

SEQ ID NO: 2621 - DNA, 16 bp, Artificial sequence
  Synthetic oligonucleotide
gattgatgtgatagct

SEQ ID NO: 2622 - DNA, 16 bp, Artificial sequence
  Synthetic oligonucleotide
ctactattgtggaaaa

SEQ ID NO: 2623 - DNA, 16 bp, Artificial sequence
  Synthetic oligonucleotide
cttaattctgggttaa

SEQ ID NO: 2624 - DNA, 16 bp, Artificial sequence
  Synthetic oligonucleotide
acattactgagatatc

SEQ ID NO: 2625 - DNA, 16 bp, Artificial sequence
  Synthetic oligonucleotide
cgaaaacagccgccgg

SEQ ID NO: 2626 - DNA, 16 bp, Artificial sequence
  Synthetic oligonucleotide
acgcagcctctaagaa

SEQ ID NO: 2627 - DNA, 16 bp, Artificial sequence
  Synthetic oligonucleotide
gtgatgtcaggttttc

SEQ ID NO: 2628 - DNA, 16 bp, Artificial sequence
  Synthetic oligonucleotide
aagcattttatcatcc

SEQ ID NO: 2629 - DNA, 16 bp, Artificial sequence
  Synthetic oligonucleotide
cagtgatgtcaggttt

SEQ ID NO: 2630 - DNA, 16 bp, Artificial sequence
  Synthetic oligonucleotide
gaagcattttatcatc

SEQ ID NO: 2631 - DNA, 16 bp, Artificial sequence
  Synthetic oligonucleotide
gcagtgatgtcaggtt

SEQ ID NO: 2632 - DNA, 16 bp, Artificial sequence
  Synthetic oligonucleotide
tctctatagtgttcca

SEQ ID NO: 2633 - DNA, 16 bp, Artificial sequence
  Synthetic oligonucleotide
aagcttgataaaggct

SEQ ID NO: 2634 - DNA, 16 bp, Artificial sequence
  Synthetic oligonucleotide
catccgaaaagactgg

SEQ ID NO: 2635 - DNA, 16 bp, Artificial sequence
  Synthetic oligonucleotide
tcatccgaaaagactg

SEQ ID NO: 2636 - DNA, 16 bp, Artificial sequence
  Synthetic oligonucleotide
atcatccgaaaagact

SEQ ID NO: 2637 - DNA, 16 bp, Artificial sequence
  Synthetic oligonucleotide
tatcatccgaaaagac

SEQ ID NO: 2638 - DNA, 16 bp, Artificial sequence
  Synthetic oligonucleotide
ttatcatccgaaaaga

SEQ ID NO: 2639 - DNA, 16 bp, Artificial sequence
  Synthetic oligonucleotide
tttatcatccgaaaag

SEQ ID NO: 2640 - DNA, 16 bp, Artificial sequence
  Synthetic oligonucleotide
cagccgaagcatttta

SEQ ID NO: 2641 - DNA, 16 bp, Artificial sequence
  Synthetic oligonucleotide
acagccgaagcatttt

SEQ ID NO: 2642 - DNA, 16 bp, Artificial sequence
  Synthetic oligonucleotide
gacagccgaagcattt

SEQ ID NO: 2643 - DNA, 16 bp, Artificial sequence
  Synthetic oligonucleotide
ccacaagcagtgatgt

SEQ ID NO: 2644 - DNA, 16 bp, Artificial sequence
  Synthetic oligonucleotide
accacaagcagtgatg

SEQ ID NO: 2645 - DNA, 16 bp, Artificial sequence
  Synthetic oligonucleotide
aacggcctggaggtga

SEQ ID NO: 2646 - DNA, 16 bp, Artificial sequence
  Synthetic oligonucleotide
aaacggcctggaggtg

SEQ ID NO: 2647 - DNA, 16 bp, Artificial sequence
  Synthetic oligonucleotide
gaaacggcctggaggt

SEQ ID NO: 2648 - DNA, 16 bp, Artificial sequence
  Synthetic oligonucleotide
tcctgtagtatgagaa

SEQ ID NO: 2649 - DNA, 16 bp, Artificial sequence
  Synthetic oligonucleotide
tatcctgtagtatgag

SEQ ID NO: 2650 - DNA, 16 bp, Artificial sequence
  Synthetic oligonucleotide
tgctcactaagcttga

SEQ ID NO: 2651 - DNA, 16 bp, Artificial sequence
  Synthetic oligonucleotide
taattactgcttgagg

SEQ ID NO: 2652 - DNA, 16 bp, Artificial sequence
  Synthetic oligonucleotide
gtgttccaggagatat

SEQ ID NO: 2653 - DNA, 16 bp, Artificial sequence
  Synthetic oligonucleotide
tagtgttccaggagat

SEQ ID NO: 2654 - DNA, 16 bp, Artificial sequence
  Synthetic oligonucleotide
cttggttctctatagt

SEQ ID NO: 2655 - DNA, 16 bp, Artificial sequence
  Synthetic oligonucleotide
tgaacggaagtttaca

SEQ ID NO: 2656 - DNA, 16 bp, Artificial sequence
  Synthetic oligonucleotide
tacctcagtttgtgaa

SEQ ID NO: 2657 - DNA, 16 bp, Artificial sequence
  Synthetic oligonucleotide
ccttacctcgccctgg

SEQ ID NO: 2658 - DNA, 16 bp, Artificial sequence
  Synthetic oligonucleotide
cgccagcgggtgagca

SEQ ID NO: 2659 - DNA, 16 bp, Artificial sequence
  Synthetic oligonucleotide
ggcgacgacagctgcg

SEQ ID NO: 2660 - DNA, 16 bp, Artificial sequence
  Synthetic oligonucleotide
agctagcgcgcactaa

SEQ ID NO: 2661 - DNA, 16 bp, Artificial sequence
  Synthetic oligonucleotide
tcctgtaacgcacccg

SEQ ID NO: 2662 - DNA, 16 bp, Artificial sequence
  Synthetic oligonucleotide
cctgatgcctccgccg

SEQ ID NO: 2663 - DNA, 16 bp, Artificial sequence
  Synthetic oligonucleotide
cgagaacgcacggacg

SEQ ID NO: 2664 - DNA, 16 bp, Artificial sequence
  Synthetic oligonucleotide
gcacaggcgcggacgc

SEQ ID NO: 2665 - DNA, 16 bp, Artificial sequence
  Synthetic oligonucleotide
gtgcactcgcgcaaag

SEQ ID NO: 2666 - DNA, 16 bp, Artificial sequence
  Synthetic oligonucleotide
tgcggaggttccttga

SEQ ID NO: 2667 - DNA, 16 bp, Artificial sequence
  Synthetic oligonucleotide
ctgccaagttgaagac

SEQ ID NO: 2668 - DNA, 16 bp, Artificial sequence
  Synthetic oligonucleotide
gtccttcagatttaca

SEQ ID NO: 2669 - DNA, 16 bp, Artificial sequence
  Synthetic oligonucleotide
atacatgtctggttta

SEQ ID NO: 2670 - DNA, 16 bp, Artificial sequence
  Synthetic oligonucleotide
ttttggctccctcagg

SEQ ID NO: 2671 - DNA, 16 bp, Artificial sequence
  Synthetic oligonucleotide
tttcaacttgtgaccc

SEQ ID NO: 2672 - DNA, 16 bp, Artificial sequence
  Synthetic oligonucleotide
atacattgaggcatac

SEQ ID NO: 2673 - DNA, 16 bp, Artificial sequence
  Synthetic oligonucleotide
gacataaaggaccccg

SEQ ID NO: 2674 - DNA, 16 bp, Artificial sequence
  Synthetic oligonucleotide
ggtctgagttgtacag

SEQ ID NO: 2675 - DNA, 16 bp, Artificial sequence
  Synthetic oligonucleotide
caccaatggcagcacc

SEQ ID NO: 2676 - DNA, 16 bp, Artificial sequence
  Synthetic oligonucleotide
catgataaggcactac

SEQ ID NO: 2677 - DNA, 16 bp, Artificial sequence
  Synthetic oligonucleotide
tggagatacttgtact

SEQ ID NO: 2678 - DNA, 16 bp, Artificial sequence
  Synthetic oligonucleotide
atcccttattagactg

SEQ ID NO: 2679 - DNA, 16 bp, Artificial sequence
  Synthetic oligonucleotide
ccagcttcggtcgagg

SEQ ID NO: 2680 - DNA, 16 bp, Artificial sequence
  Synthetic oligonucleotide
gtcatgggacattggt

SEQ ID NO: 2681 - DNA, 16 bp, Artificial sequence
  Synthetic oligonucleotide
ctgagagtaaacttgg

SEQ ID NO: 2682 - DNA, 16 bp, Artificial sequence
  Synthetic oligonucleotide
gctcaataatctccca

SEQ ID NO: 2683 - DNA, 16 bp, Artificial sequence
  Synthetic oligonucleotide
gtgtttgccatggtat

SEQ ID NO: 2684 - DNA, 16 bp, Artificial sequence
  Synthetic oligonucleotide
cgcattgctagattct

SEQ ID NO: 2685 - DNA, 16 bp, Artificial sequence
  Synthetic oligonucleotide
ggataacctgaacatg

SEQ ID NO: 2686 - DNA, 16 bp, Artificial sequence
  Synthetic oligonucleotide
ccatattggaaaccag

SEQ ID NO: 2687 - DNA, 16 bp, Artificial sequence
  Synthetic oligonucleotide
cagtaaacgcaagtct

SEQ ID NO: 2688 - DNA, 16 bp, Artificial sequence
  Synthetic oligonucleotide
agacaggtctctacct

SEQ ID NO: 2689 - DNA, 16 bp, Artificial sequence
  Synthetic oligonucleotide
tgccaaagagcccaat

SEQ ID NO: 2690 - DNA, 16 bp, Artificial sequence
  Synthetic oligonucleotide
aactagcagggcacgc

SEQ ID NO: 2691 - DNA, 16 bp, Artificial sequence
  Synthetic oligonucleotide
ggactccgggagcctg

SEQ ID NO: 2692 - DNA, 16 bp, Artificial sequence
  Synthetic oligonucleotide
tttctaatggtgctcc

SEQ ID NO: 2693 - DNA, 16 bp, Artificial sequence
  Synthetic oligonucleotide
aactaatgtccccagg

SEQ ID NO: 2694 - DNA, 16 bp, Artificial sequence
  Synthetic oligonucleotide
ttgtttgcaagctata

SEQ ID NO: 2695 - DNA, 16 bp, Artificial sequence
  Synthetic oligonucleotide
ttctttatagtaggta

SEQ ID NO: 2696 - DNA, 16 bp, Artificial sequence
  Synthetic oligonucleotide
gaattccaaaccttaa

SEQ ID NO: 2697 - DNA, 16 bp, Artificial sequence
  Synthetic oligonucleotide
acacaagtcttaggtg

SEQ ID NO: 2698 - DNA, 16 bp, Artificial sequence
  Synthetic oligonucleotide
tcagaaatcacgaggt

SEQ ID NO: 2699 - DNA, 16 bp, Artificial sequence
  Synthetic oligonucleotide
taatctgtatcatgca

SEQ ID NO: 2700 - DNA, 16 bp, Artificial sequence
  Synthetic oligonucleotide
agctgccactggtaac

SEQ ID NO: 2701 - DNA, 16 bp, Artificial sequence
  Synthetic oligonucleotide
ggccttaatggtgatt

SEQ ID NO: 2702 - DNA, 16 bp, Artificial sequence
  Synthetic oligonucleotide
gaaatgaaccctaagt

SEQ ID NO: 2703 - DNA, 16 bp, Artificial sequence
  Synthetic oligonucleotide
accgactcttttttta

SEQ ID NO: 2704 - DNA, 16 bp, Artificial sequence
  Synthetic oligonucleotide
cagagctccggagtca

SEQ ID NO: 2705 - DNA, 16 bp, Artificial sequence
  Synthetic oligonucleotide
gcgactgctgaaaacc

SEQ ID NO: 2706 - DNA, 16 bp, Artificial sequence
  Synthetic oligonucleotide
agtacagtccactcca

SEQ ID NO: 2707 - DNA, 16 bp, Artificial sequence
  Synthetic oligonucleotide
ccaacttatagcactc

SEQ ID NO: 2708 - DNA, 16 bp, Artificial sequence
  Synthetic oligonucleotide
acaaaaacttgggtca

SEQ ID NO: 2709 - DNA, 16 bp, Artificial sequence
  Synthetic oligonucleotide
gatgggaccgccctgg

SEQ ID NO: 2710 - DNA, 16 bp, Artificial sequence
  Synthetic oligonucleotide
ctagtcgcgcaagtct

SEQ ID NO: 2711 - DNA, 16 bp, Artificial sequence
  Synthetic oligonucleotide
cagaatggcgagttgg

SEQ ID NO: 2712 - DNA, 16 bp, Artificial sequence
  Synthetic oligonucleotide
cttagtcagaatctgt

SEQ ID NO: 2713 - DNA, 16 bp, Artificial sequence
  Synthetic oligonucleotide
taaaatgtcacgcccg

SEQ ID NO: 2714 - DNA, 16 bp, Artificial sequence
  Synthetic oligonucleotide
caccagccatcggcag

SEQ ID NO: 2715 - DNA, 16 bp, Artificial sequence
  Synthetic oligonucleotide
agtgaagtcgggagat

SEQ ID NO: 2716 - DNA, 16 bp, Artificial sequence
  Synthetic oligonucleotide
ggctcttgatgtgaac

SEQ ID NO: 2717 - DNA, 16 bp, Artificial sequence
  Synthetic oligonucleotide
atcaccgaacacacca

SEQ ID NO: 2718 - DNA, 16 bp, Artificial sequence
  Synthetic oligonucleotide
agcagtgatgtcaggt

SEQ ID NO: 2719 - DNA, 16 bp, Artificial sequence
  Synthetic oligonucleotide
gccaaggaggcgggcc

SEQ ID NO: 2720 - DNA, 16 bp, Artificial sequence
  Synthetic oligonucleotide
acccaaatgtggagct

SEQ ID NO: 2721 - DNA, 16 bp, Artificial sequence
  Synthetic oligonucleotide
ggagagggcgacgaca

SEQ ID NO: 2722 - DNA, 16 bp, Artificial sequence
  Synthetic oligonucleotide
gaataggacccctatc

SEQ ID NO: 2723 - DNA, 16 bp, Artificial sequence
  Synthetic oligonucleotide
tccgagctcggccccc

SEQ ID NO: 2724 - DNA, 16 bp, Artificial sequence
  Synthetic oligonucleotide
tgcggctccggcgacg

SEQ ID NO: 2725 - DNA, 16 bp, Artificial sequence
  Synthetic oligonucleotide
aaacgagaacgcacgg

SEQ ID NO: 2726 - DNA, 16 bp, Artificial sequence
  Synthetic oligonucleotide
cgccggcacaggcgcg

SEQ ID NO: 2727 - DNA, 16 bp, Artificial sequence
  Synthetic oligonucleotide
gtgtgtgcactcgcgc

SEQ ID NO: 2728 - DNA, 16 bp, Artificial sequence
  Synthetic oligonucleotide
agatgcggaggttcct

SEQ ID NO: 2729 - DNA, 16 bp, Artificial sequence
  Synthetic oligonucleotide
cctatcactgccaagt

SEQ ID NO: 2730 - DNA, 16 bp, Artificial sequence
  Synthetic oligonucleotide
cataggtccttcagat

SEQ ID NO: 2731 - DNA, 16 bp, Artificial sequence
  Synthetic oligonucleotide
caaagcgcaccgcagg

SEQ ID NO: 2732 - DNA, 16 bp, Artificial sequence
  Synthetic oligonucleotide
ccctaccttttttggc

SEQ ID NO: 2733 - DNA, 16 bp, Artificial sequence
  Synthetic oligonucleotide
gctgaaccccacagga

SEQ ID NO: 2734 - DNA, 16 bp, Artificial sequence
  Synthetic oligonucleotide
tatacattgaggcata

SEQ ID NO: 2735 - DNA, 16 bp, Artificial sequence
  Synthetic oligonucleotide
gtgacataaaggaccc

SEQ ID NO: 2736 - DNA, 16 bp, Artificial sequence
  Synthetic oligonucleotide
aaggtctgagttgtac

SEQ ID NO: 2737 - DNA, 16 bp, Artificial sequence
  Synthetic oligonucleotide
cccgaccctccccaac

SEQ ID NO: 2738 - DNA, 16 bp, Artificial sequence
  Synthetic oligonucleotide
cacatgataaggcact

SEQ ID NO: 2739 - DNA, 16 bp, Artificial sequence
  Synthetic oligonucleotide
caatggagatacttgt

SEQ ID NO: 2740 - DNA, 16 bp, Artificial sequence
  Synthetic oligonucleotide
gggaatcccttattag

SEQ ID NO: 2741 - DNA, 16 bp, Artificial sequence
  Synthetic oligonucleotide
ctccagcttcggtcga

SEQ ID NO: 2742 - DNA, 16 bp, Artificial sequence
  Synthetic oligonucleotide
agcaattagctcttct

SEQ ID NO: 2743 - DNA, 16 bp, Artificial sequence
  Synthetic oligonucleotide
gatcctgagagtaaac

SEQ ID NO: 2744 - DNA, 16 bp, Artificial sequence
  Synthetic oligonucleotide
agctcaataatctccc

SEQ ID NO: 2745 - DNA, 16 bp, Artificial sequence
  Synthetic oligonucleotide
ccacaatcagcaagtc

SEQ ID NO: 2746 - DNA, 16 bp, Artificial sequence
  Synthetic oligonucleotide
accgcattgctagatt

SEQ ID NO: 2747 - DNA, 16 bp, Artificial sequence
  Synthetic oligonucleotide
gcagccaaggataacc

SEQ ID NO: 2748 - DNA, 16 bp, Artificial sequence
  Synthetic oligonucleotide
tccactaccatattgg

SEQ ID NO: 2749 - DNA, 16 bp, Artificial sequence
  Synthetic oligonucleotide
agcagtaaacgcaagt

SEQ ID NO: 2750 - DNA, 16 bp, Artificial sequence
  Synthetic oligonucleotide
gcttcaagacaggtct

SEQ ID NO: 2751 - DNA, 16 bp, Artificial sequence
  Synthetic oligonucleotide
gctgagagttcaggtc

SEQ ID NO: 2752 - DNA, 16 bp, Artificial sequence
  Synthetic oligonucleotide
agcaactagcagggca

SEQ ID NO: 2753 - DNA, 16 bp, Artificial sequence
  Synthetic oligonucleotide
tcgaatctgcccaaag

SEQ ID NO: 2754 - DNA, 16 bp, Artificial sequence
  Synthetic oligonucleotide
ccagaactaatgtccc

SEQ ID NO: 2755 - DNA, 16 bp, Artificial sequence
  Synthetic oligonucleotide
tatttgtttgcaagct

SEQ ID NO: 2756 - DNA, 16 bp, Artificial sequence
  Synthetic oligonucleotide
agaggtgccttcttta

SEQ ID NO: 2757 - DNA, 16 bp, Artificial sequence
  Synthetic oligonucleotide
ccacaactctcgcctc

SEQ ID NO: 2758 - DNA, 16 bp, Artificial sequence
  Synthetic oligonucleotide
ccacacaagtcttagg

SEQ ID NO: 2759 - DNA, 16 bp, Artificial sequence
  Synthetic oligonucleotide
cgaggtgattctcggg

SEQ ID NO: 2760 - DNA, 16 bp, Artificial sequence
  Synthetic oligonucleotide
gctgataattaatctg

SEQ ID NO: 2761 - DNA, 16 bp, Artificial sequence
  Synthetic oligonucleotide
cgcccatgagttgaaa

SEQ ID NO: 2762 - DNA, 16 bp, Artificial sequence
  Synthetic oligonucleotide
aaagggtaagcactga

SEQ ID NO: 2763 - DNA, 16 bp, Artificial sequence
  Synthetic oligonucleotide
atttaagtcatgtgtc

SEQ ID NO: 2764 - DNA, 16 bp, Artificial sequence
  Synthetic oligonucleotide
gccaccgactcttttt

SEQ ID NO: 2765 - DNA, 16 bp, Artificial sequence
  Synthetic oligonucleotide
cggcagtctgcaaaca

SEQ ID NO: 2766 - DNA, 16 bp, Artificial sequence
  Synthetic oligonucleotide
ggcgactgctgaaaac

SEQ ID NO: 2767 - DNA, 16 bp, Artificial sequence
  Synthetic oligonucleotide
cagtacagtccactcc

SEQ ID NO: 2768 - DNA, 16 bp, Artificial sequence
  Synthetic oligonucleotide
gccaacttatagcact

SEQ ID NO: 2769 - DNA, 16 bp, Artificial sequence
  Synthetic oligonucleotide
tctggatgagcttaca

SEQ ID NO: 2770 - DNA, 16 bp, Artificial sequence
  Synthetic oligonucleotide
atccactggcaccaag

SEQ ID NO: 2771 - DNA, 16 bp, Artificial sequence
  Synthetic oligonucleotide
ttctagtcgcgcaagt

SEQ ID NO: 2772 - DNA, 16 bp, Artificial sequence
  Synthetic oligonucleotide
ctacacaggctaatca

SEQ ID NO: 2773 - DNA, 16 bp, Artificial sequence
  Synthetic oligonucleotide
gacttagtcagaatct

SEQ ID NO: 2774 - DNA, 16 bp, Artificial sequence
  Synthetic oligonucleotide
aataaaatgtcacgcc

SEQ ID NO: 2775 - DNA, 16 bp, Artificial sequence
  Synthetic oligonucleotide
cagaatgtttcgacat

SEQ ID NO: 2776 - DNA, 16 bp, Artificial sequence
  Synthetic oligonucleotide
ccacagtgaagtcggg

SEQ ID NO: 2777 - DNA, 16 bp, Artificial sequence
  Synthetic oligonucleotide
ttactccgctgagtgg

SEQ ID NO: 2778 - DNA, 16 bp, Artificial sequence
  Synthetic oligonucleotide
ctcatcaccgaacaca

SEQ ID NO: 2779 - DNA, 16 bp, Artificial sequence
  Synthetic oligonucleotide
gcgcggagggcaggcg

SEQ ID NO: 2780 - DNA, 16 bp, Artificial sequence
  Synthetic oligonucleotide
agcgacccaaatgtgg

SEQ ID NO: 2781 - DNA, 16 bp, Artificial sequence
  Synthetic oligonucleotide
gcccgggagagcggag

SEQ ID NO: 2782 - DNA, 16 bp, Artificial sequence
  Synthetic oligonucleotide
cgcggaggacctcgcc

SEQ ID NO: 2783 - DNA, 16 bp, Artificial sequence
  Synthetic oligonucleotide
gcgggcacagccgtcc

SEQ ID NO: 2784 - DNA, 16 bp, Artificial sequence
  Synthetic oligonucleotide
agccgaggcctccttt

SEQ ID NO: 2785 - DNA, 16 bp, Artificial sequence
  Synthetic oligonucleotide
tggaaacgagaacgca

SEQ ID NO: 2786 - DNA, 16 bp, Artificial sequence
  Synthetic oligonucleotide
aaaacagccgccggca

SEQ ID NO: 2787 - DNA, 16 bp, Artificial sequence
  Synthetic oligonucleotide
cgtaacaacgacacac

SEQ ID NO: 2788 - DNA, 16 bp, Artificial sequence
  Synthetic oligonucleotide
gtgagatgcggaggtt

SEQ ID NO: 2789 - DNA, 16 bp, Artificial sequence
  Synthetic oligonucleotide
agctatgctctaggaa

SEQ ID NO: 2790 - DNA, 16 bp, Artificial sequence
  Synthetic oligonucleotide
cgcataggtccttcag

SEQ ID NO: 2791 - DNA, 16 bp, Artificial sequence
  Synthetic oligonucleotide
gtcattgctcttgttc

SEQ ID NO: 2792 - DNA, 16 bp, Artificial sequence
  Synthetic oligonucleotide
agagcccctacctttt

SEQ ID NO: 2793 - DNA, 16 bp, Artificial sequence
  Synthetic oligonucleotide
atgctgaaccccacag

SEQ ID NO: 2794 - DNA, 16 bp, Artificial sequence
  Synthetic oligonucleotide
atatacattgaggcat

SEQ ID NO: 2795 - DNA, 16 bp, Artificial sequence
  Synthetic oligonucleotide
gcgaatgtgccttgtg

SEQ ID NO: 2796 - DNA, 16 bp, Artificial sequence
  Synthetic oligonucleotide
tacaaggtctgagttg

SEQ ID NO: 2797 - DNA, 16 bp, Artificial sequence
  Synthetic oligonucleotide
cgcccgaccctcccca

SEQ ID NO: 2798 - DNA, 16 bp, Artificial sequence
  Synthetic oligonucleotide
tcacatgataaggcac

SEQ ID NO: 2799 - DNA, 16 bp, Artificial sequence
  Synthetic oligonucleotide
ggacaatggagatact

SEQ ID NO: 2800 - DNA, 16 bp, Artificial sequence
  Synthetic oligonucleotide
tcagggaatcccttat

SEQ ID NO: 2801 - DNA, 16 bp, Artificial sequence
  Synthetic oligonucleotide
tccctccagcttcggt

SEQ ID NO: 2802 - DNA, 16 bp, Artificial sequence
  Synthetic oligonucleotide
cattagcaattagctc

SEQ ID NO: 2803 - DNA, 16 bp, Artificial sequence
  Synthetic oligonucleotide
tggatcctgagagtaa

SEQ ID NO: 2804 - DNA, 16 bp, Artificial sequence
  Synthetic oligonucleotide
taccagctcaataatc

SEQ ID NO: 2805 - DNA, 16 bp, Artificial sequence
  Synthetic oligonucleotide
taatccacaatcagca

SEQ ID NO: 2806 - DNA, 16 bp, Artificial sequence
  Synthetic oligonucleotide
gttaccgcattgctag

SEQ ID NO: 2807 - DNA, 16 bp, Artificial sequence
  Synthetic oligonucleotide
actacctgcagccaag

SEQ ID NO: 2808 - DNA, 16 bp, Artificial sequence
  Synthetic oligonucleotide
tcctccactaccatat

SEQ ID NO: 2809 - DNA, 16 bp, Artificial sequence
  Synthetic oligonucleotide
ccagagcagtaaacgc

SEQ ID NO: 2810 - DNA, 16 bp, Artificial sequence
  Synthetic oligonucleotide
ccgatgcttcaagaca

SEQ ID NO: 2811 - DNA, 16 bp, Artificial sequence
  Synthetic oligonucleotide
gttcacaacagagctg

SEQ ID NO: 2812 - DNA, 16 bp, Artificial sequence
  Synthetic oligonucleotide
cgcccaatcaccttcc

SEQ ID NO: 2813 - DNA, 16 bp, Artificial sequence
  Synthetic oligonucleotide
cccatcgaatctgccc

SEQ ID NO: 2814 - DNA, 16 bp, Artificial sequence
  Synthetic oligonucleotide
gaaccacaagcagtga

SEQ ID NO: 2815 - DNA, 16 bp, Artificial sequence
  Synthetic oligonucleotide
gaccagaactaatgtc

SEQ ID NO: 2816 - DNA, 16 bp, Artificial sequence
  Synthetic oligonucleotide
cagattgaatccatat

SEQ ID NO: 2817 - DNA, 16 bp, Artificial sequence
  Synthetic oligonucleotide
gcctagaggtgccttc

SEQ ID NO: 2818 - DNA, 16 bp, Artificial sequence
  Synthetic oligonucleotide
aaagagctggtaggtc

SEQ ID NO: 2819 - DNA, 16 bp, Artificial sequence
  Synthetic oligonucleotide
ctcttcaggcacccac

SEQ ID NO: 2820 - DNA, 16 bp, Artificial sequence
  Synthetic oligonucleotide
cattcgaggtgattct

SEQ ID NO: 2821 - DNA, 16 bp, Artificial sequence
  Synthetic oligonucleotide
tggctgataattaatc

SEQ ID NO: 2822 - DNA, 16 bp, Artificial sequence
  Synthetic oligonucleotide
tttaaaatatcgccca

SEQ ID NO: 2823 - DNA, 16 bp, Artificial sequence
  Synthetic oligonucleotide
ttaaagggtaagcact

SEQ ID NO: 2824 - DNA, 16 bp, Artificial sequence
  Synthetic oligonucleotide
acttgctaagtcttat

SEQ ID NO: 2825 - DNA, 16 bp, Artificial sequence
  Synthetic oligonucleotide
tggagaagtcccgtgg

SEQ ID NO: 2826 - DNA, 16 bp, Artificial sequence
  Synthetic oligonucleotide
ccttacctgacaagaa

SEQ ID NO: 2827 - DNA, 16 bp, Artificial sequence
  Synthetic oligonucleotide
agaggcgactgctgaa

SEQ ID NO: 2828 - DNA, 16 bp, Artificial sequence
  Synthetic oligonucleotide
ccagtacagtccactc

SEQ ID NO: 2829 - DNA, 16 bp, Artificial sequence
  Synthetic oligonucleotide
cgctgaattgtcatga

SEQ ID NO: 2830 - DNA, 16 bp, Artificial sequence
  Synthetic oligonucleotide
aatctggatgagctta

SEQ ID NO: 2831 - DNA, 16 bp, Artificial sequence
  Synthetic oligonucleotide
tcattagaaagccctc

SEQ ID NO: 2832 - DNA, 16 bp, Artificial sequence
  Synthetic oligonucleotide
aagttctagtcgcgca

SEQ ID NO: 2833 - DNA, 16 bp, Artificial sequence
  Synthetic oligonucleotide
acctacacaggctaat

SEQ ID NO: 2834 - DNA, 16 bp, Artificial sequence
  Synthetic oligonucleotide
gctaacttacaggact

SEQ ID NO: 2835 - DNA, 16 bp, Artificial sequence
  Synthetic oligonucleotide
agacaagtgcccatcc

SEQ ID NO: 2836 - DNA, 16 bp, Artificial sequence
  Synthetic oligonucleotide
tcagaatgtttcgaca

SEQ ID NO: 2837 - DNA, 16 bp, Artificial sequence
  Synthetic oligonucleotide
ggtagtagaccacagt

SEQ ID NO: 2838 - DNA, 16 bp, Artificial sequence
  Synthetic oligonucleotide
cactcttactccgctg

SEQ ID NO: 2839 - DNA, 16 bp, Artificial sequence
  Synthetic oligonucleotide
ccctcatcaccgaaca

SEQ ID NO: 2840 - DNA, 16 bp, Artificial sequence
  Synthetic oligonucleotide
cgcaggagcgcggagg

SEQ ID NO: 2841 - DNA, 16 bp, Artificial sequence
  Synthetic oligonucleotide
tcggagcgacccaaat

SEQ ID NO: 2842 - DNA, 16 bp, Artificial sequence
  Synthetic oligonucleotide
attccgcgcgcagagc

SEQ ID NO: 2843 - DNA, 16 bp, Artificial sequence
  Synthetic oligonucleotide
tccacgcgcggaggac

SEQ ID NO: 2844 - DNA, 16 bp, Artificial sequence
  Synthetic oligonucleotide
accttcgcggccggcc

SEQ ID NO: 2845 - DNA, 16 bp, Artificial sequence
  Synthetic oligonucleotide
cgcccaggacccggct

SEQ ID NO: 2846 - DNA, 16 bp, Artificial sequence
  Synthetic oligonucleotide
cgggagcccggaggaa

SEQ ID NO: 2847 - DNA, 16 bp, Artificial sequence
  Synthetic oligonucleotide
gagagacgaaaacagc

SEQ ID NO: 2848 - DNA, 16 bp, Artificial sequence
  Synthetic oligonucleotide
gaggaagtccccttcc

SEQ ID NO: 2849 - DNA, 16 bp, Artificial sequence
  Synthetic oligonucleotide
gagtgagatgcggagg

SEQ ID NO: 2850 - DNA, 16 bp, Artificial sequence
  Synthetic oligonucleotide
ccccagctatgctcta

SEQ ID NO: 2851 - DNA, 16 bp, Artificial sequence
  Synthetic oligonucleotide
ggcgcataggtccttc

SEQ ID NO: 2852 - DNA, 16 bp, Artificial sequence
  Synthetic oligonucleotide
tcaaccagttcctcaa

SEQ ID NO: 2853 - DNA, 16 bp, Artificial sequence
  Synthetic oligonucleotide
caggagagcccctacc

SEQ ID NO: 2854 - DNA, 16 bp, Artificial sequence
  Synthetic oligonucleotide
cctatgctgaacccca

SEQ ID NO: 2855 - DNA, 16 bp, Artificial sequence
  Synthetic oligonucleotide
catatacattgaggca

SEQ ID NO: 2856 - DNA, 16 bp, Artificial sequence
  Synthetic oligonucleotide
tggcatgcgaatgtgc

SEQ ID NO: 2857 - DNA, 16 bp, Artificial sequence
  Synthetic oligonucleotide
tttctacaaggtctga

SEQ ID NO: 2858 - DNA, 16 bp, Artificial sequence
  Synthetic oligonucleotide
acacgcccgaccctcc

SEQ ID NO: 2859 - DNA, 16 bp, Artificial sequence
  Synthetic oligonucleotide
tgtggtttcacatgat

SEQ ID NO: 2860 - DNA, 16 bp, Artificial sequence
  Synthetic oligonucleotide
ggaggatcataaagga

SEQ ID NO: 2861 - DNA, 16 bp, Artificial sequence
  Synthetic oligonucleotide
gtgctcttacagcctc

SEQ ID NO: 2862 - DNA, 16 bp, Artificial sequence
  Synthetic oligonucleotide
cgtagtccctccagct

SEQ ID NO: 2863 - DNA, 16 bp, Artificial sequence
  Synthetic oligonucleotide
ggccacattagcaatt

SEQ ID NO: 2864 - DNA, 16 bp, Artificial sequence
  Synthetic oligonucleotide
gcatggatcctgagag

SEQ ID NO: 2865 - DNA, 16 bp, Artificial sequence
  Synthetic oligonucleotide
ttcgagagaaatatac

SEQ ID NO: 2866 - DNA, 16 bp, Artificial sequence
  Synthetic oligonucleotide
catctaatccacaatc

SEQ ID NO: 2867 - DNA, 16 bp, Artificial sequence
  Synthetic oligonucleotide
gagttaccgcattgct

SEQ ID NO: 2868 - DNA, 16 bp, Artificial sequence
  Synthetic oligonucleotide
tcactacctgcagcca

SEQ ID NO: 2869 - DNA, 16 bp, Artificial sequence
  Synthetic oligonucleotide
aattcctccactacca

SEQ ID NO: 2870 - DNA, 16 bp, Artificial sequence
  Synthetic oligonucleotide
gagccagagcagtaaa

SEQ ID NO: 2871 - DNA, 16 bp, Artificial sequence
  Synthetic oligonucleotide
taccgatgcttcaaga

SEQ ID NO: 2872 - DNA, 16 bp, Artificial sequence
  Synthetic oligonucleotide
cacaaagcgggttcac

SEQ ID NO: 2873 - DNA, 16 bp, Artificial sequence
  Synthetic oligonucleotide
agagagtccgacgcac

SEQ ID NO: 2874 - DNA, 16 bp, Artificial sequence
  Synthetic oligonucleotide
tcccatcgaatctgcc

SEQ ID NO: 2875 - DNA, 16 bp, Artificial sequence
  Synthetic oligonucleotide
cggtcagcagaaccac

SEQ ID NO: 2876 - DNA, 16 bp, Artificial sequence
  Synthetic oligonucleotide
atgagggaccagaact

SEQ ID NO: 2877 - DNA, 16 bp, Artificial sequence
  Synthetic oligonucleotide
atcagattgaatccat

SEQ ID NO: 2878 - DNA, 16 bp, Artificial sequence
  Synthetic oligonucleotide
aagcctagaggtgcct

SEQ ID NO: 2879 - DNA, 16 bp, Artificial sequence
  Synthetic oligonucleotide
cctcattcacaactag

SEQ ID NO: 2880 - DNA, 16 bp, Artificial sequence
  Synthetic oligonucleotide
ctactcttcaggcacc

SEQ ID NO: 2881 - DNA, 16 bp, Artificial sequence
  Synthetic oligonucleotide
ggccattcgaggtgat

SEQ ID NO: 2882 - DNA, 16 bp, Artificial sequence
  Synthetic oligonucleotide
gctcatggctgataat

SEQ ID NO: 2883 - DNA, 16 bp, Artificial sequence
  Synthetic oligonucleotide
tctttaaaatatcgcc

SEQ ID NO: 2884 - DNA, 16 bp, Artificial sequence
  Synthetic oligonucleotide
acattaaagggtaagc

SEQ ID NO: 2885 - DNA, 16 bp, Artificial sequence
  Synthetic oligonucleotide
agaacttgctaagtct

SEQ ID NO: 2886 - DNA, 16 bp, Artificial sequence
  Synthetic oligonucleotide
ggtcaacacttggaga

SEQ ID NO: 2887 - DNA, 16 bp, Artificial sequence
  Synthetic oligonucleotide
tgccttacctgacaag

SEQ ID NO: 2888 - DNA, 16 bp, Artificial sequence
  Synthetic oligonucleotide
tttaagaggcgactgc

SEQ ID NO: 2889 - DNA, 16 bp, Artificial sequence
  Synthetic oligonucleotide
aaaccagtacagtcca

SEQ ID NO: 2890 - DNA, 16 bp, Artificial sequence
  Synthetic oligonucleotide
cccacgcgggaggctc

SEQ ID NO: 2891 - DNA, 16 bp, Artificial sequence
  Synthetic oligonucleotide
ctttgggcaccaaaag

SEQ ID NO: 2892 - DNA, 16 bp, Artificial sequence
  Synthetic oligonucleotide
ttcattagaaagccct

SEQ ID NO: 2893 - DNA, 16 bp, Artificial sequence
  Synthetic oligonucleotide
tagtaagttctagtcg

SEQ ID NO: 2894 - DNA, 16 bp, Artificial sequence
  Synthetic oligonucleotide
ctgagactacacctac

SEQ ID NO: 2895 - DNA, 16 bp, Artificial sequence
  Synthetic oligonucleotide
ttctagctaacttaca

SEQ ID NO: 2896 - DNA, 16 bp, Artificial sequence
  Synthetic oligonucleotide
gactggaacattgttg

SEQ ID NO: 2897 - DNA, 16 bp, Artificial sequence
  Synthetic oligonucleotide
tgccatggacaagttt

SEQ ID NO: 2898 - DNA, 16 bp, Artificial sequence
  Synthetic oligonucleotide
caaaaggtagtagacc

SEQ ID NO: 2899 - DNA, 16 bp, Artificial sequence
  Synthetic oligonucleotide
gcactcttactccgct

SEQ ID NO: 2900 - DNA, 16 bp, Artificial sequence
  Synthetic oligonucleotide
gaaaccctcatcaccg

SEQ ID NO: 2901 - DNA, 16 bp, Artificial sequence
  Synthetic oligonucleotide
cgtcgcaggagcgcgg

SEQ ID NO: 2902 - DNA, 16 bp, Artificial sequence
  Synthetic oligonucleotide
gcacgcaaggctcgga

SEQ ID NO: 2903 - DNA, 16 bp, Artificial sequence
  Synthetic oligonucleotide
ggattccgcgcgcaga

SEQ ID NO: 2904 - DNA, 16 bp, Artificial sequence
  Synthetic oligonucleotide
cgcgactctgtcagtt

SEQ ID NO: 2905 - DNA, 16 bp, Artificial sequence
  Synthetic oligonucleotide
ctgcgaagcgcgcgcg

SEQ ID NO: 2906 - DNA, 16 bp, Artificial sequence
  Synthetic oligonucleotide
gccttcagcggtttcc

SEQ ID NO: 2907 - DNA, 16 bp, Artificial sequence
  Synthetic oligonucleotide
acggaggcggcagacg

SEQ ID NO: 2908 - DNA, 16 bp, Artificial sequence
  Synthetic oligonucleotide
ggtgagagacgaaaac

SEQ ID NO: 2909 - DNA, 16 bp, Artificial sequence
  Synthetic oligonucleotide
ccggaggaagtcccct

SEQ ID NO: 2910 - DNA, 16 bp, Artificial sequence
  Synthetic oligonucleotide
gtagagtgagatgcgg

SEQ ID NO: 2911 - DNA, 16 bp, Artificial sequence
  Synthetic oligonucleotide
tttacaccgttgctca

SEQ ID NO: 2912 - DNA, 16 bp, Artificial sequence
  Synthetic oligonucleotide
atggcgcataggtcct

SEQ ID NO: 2913 - DNA, 16 bp, Artificial sequence
  Synthetic oligonucleotide
ccgctcaaccagttcc

SEQ ID NO: 2914 - DNA, 16 bp, Artificial sequence
  Synthetic oligonucleotide
attcaggagagcccct

SEQ ID NO: 2915 - DNA, 16 bp, Artificial sequence
  Synthetic oligonucleotide
ctcctatgctgaaccc

SEQ ID NO: 2916 - DNA, 16 bp, Artificial sequence
  Synthetic oligonucleotide
cccatatacattgagg

SEQ ID NO: 2917 - DNA, 16 bp, Artificial sequence
  Synthetic oligonucleotide
acagatggcatgcgaa

SEQ ID NO: 2918 - DNA, 16 bp, Artificial sequence
  Synthetic oligonucleotide
tgctattaaactgatt

SEQ ID NO: 2919 - DNA, 16 bp, Artificial sequence
  Synthetic oligonucleotide
cggacacgcccgaccc

SEQ ID NO: 2920 - DNA, 16 bp, Artificial sequence
  Synthetic oligonucleotide
accaaaagtaccacag

SEQ ID NO: 2921 - DNA, 16 bp, Artificial sequence
  Synthetic oligonucleotide
gactggagtgaaccct

SEQ ID NO: 2922 - DNA, 16 bp, Artificial sequence
  Synthetic oligonucleotide
gggtgctcttacagcc

SEQ ID NO: 2923 - DNA, 16 bp, Artificial sequence
  Synthetic oligonucleotide
tccgggtgtggctgat

SEQ ID NO: 2924 - DNA, 16 bp, Artificial sequence
  Synthetic oligonucleotide
ccaggattcgccatgg

SEQ ID NO: 2925 - DNA, 16 bp, Artificial sequence
  Synthetic oligonucleotide
gcctagcatggatcct

SEQ ID NO: 2926 - DNA, 16 bp, Artificial sequence
  Synthetic oligonucleotide
cactattcgagagaaa

SEQ ID NO: 2927 - DNA, 16 bp, Artificial sequence
  Synthetic oligonucleotide
ggaccacatctaatcc

SEQ ID NO: 2928 - DNA, 16 bp, Artificial sequence
  Synthetic oligonucleotide
cctgagttaccgcatt

SEQ ID NO: 2929 - DNA, 16 bp, Artificial sequence
  Synthetic oligonucleotide
cacctcttcactacct

SEQ ID NO: 2930 - DNA, 16 bp, Artificial sequence
  Synthetic oligonucleotide
tagccaattcctccac

SEQ ID NO: 2931 - DNA, 16 bp, Artificial sequence
  Synthetic oligonucleotide
tccatagagccagagc

SEQ ID NO: 2932 - DNA, 16 bp, Artificial sequence
  Synthetic oligonucleotide
gttaccgatgcttcaa

SEQ ID NO: 2933 - DNA, 16 bp, Artificial sequence
  Synthetic oligonucleotide
actaacagggagactg

SEQ ID NO: 2934 - DNA, 16 bp, Artificial sequence
  Synthetic oligonucleotide
acagagagtccgacgc

SEQ ID NO: 2935 - DNA, 16 bp, Artificial sequence
  Synthetic oligonucleotide
ctaaagtcccatcgaa

SEQ ID NO: 2936 - DNA, 16 bp, Artificial sequence
  Synthetic oligonucleotide
ctgaaacggtcagcag

SEQ ID NO: 2937 - DNA, 16 bp, Artificial sequence
  Synthetic oligonucleotide
taggcacatcaatgtt

SEQ ID NO: 2938 - DNA, 16 bp, Artificial sequence
  Synthetic oligonucleotide
aagatctccatggtgc

SEQ ID NO: 2939 - DNA, 16 bp, Artificial sequence
  Synthetic oligonucleotide
ccaagcctagaggtgc

SEQ ID NO: 2940 - DNA, 16 bp, Artificial sequence
  Synthetic oligonucleotide
gtgcaagcctcattca

SEQ ID NO: 2941 - DNA, 16 bp, Artificial sequence
  Synthetic oligonucleotide
gttgccgagatataaa

SEQ ID NO: 2942 - DNA, 16 bp, Artificial sequence
  Synthetic oligonucleotide
agacagtgcgccccaa

SEQ ID NO: 2943 - DNA, 16 bp, Artificial sequence
  Synthetic oligonucleotide
gtgctcatggctgata

SEQ ID NO: 2944 - DNA, 16 bp, Artificial sequence
  Synthetic oligonucleotide
taaaactgcgctctct

SEQ ID NO: 2945 - DNA, 16 bp, Artificial sequence
  Synthetic oligonucleotide
ccacatacctgaaacg

SEQ ID NO: 2946 - DNA, 16 bp, Artificial sequence
  Synthetic oligonucleotide
gagcatcactattaag

SEQ ID NO: 2947 - DNA, 16 bp, Artificial sequence
  Synthetic oligonucleotide
catgagctcggtcaac

SEQ ID NO: 2948 - DNA, 16 bp, Artificial sequence
  Synthetic oligonucleotide
taacgaggtgccttac

SEQ ID NO: 2949 - DNA, 16 bp, Artificial sequence
  Synthetic oligonucleotide
tgttttaagaggcgac

SEQ ID NO: 2950 - DNA, 16 bp, Artificial sequence
  Synthetic oligonucleotide
tgtgcaaaaccagtac

SEQ ID NO: 2951 - DNA, 16 bp, Artificial sequence
  Synthetic oligonucleotide
gggtagagcagctccc

SEQ ID NO: 2952 - DNA, 16 bp, Artificial sequence
  Synthetic oligonucleotide
tttgctttgggcacca

SEQ ID NO: 2953 - DNA, 16 bp, Artificial sequence
  Synthetic oligonucleotide
tgccagttccttgtga

SEQ ID NO: 2954 - DNA, 16 bp, Artificial sequence
  Synthetic oligonucleotide
atagtaagttctagtc

SEQ ID NO: 2955 - DNA, 16 bp, Artificial sequence
  Synthetic oligonucleotide
atctgagactacacct

SEQ ID NO: 2956 - DNA, 16 bp, Artificial sequence
  Synthetic oligonucleotide
atacacaccctcgggc

SEQ ID NO: 2957 - DNA, 16 bp, Artificial sequence
  Synthetic oligonucleotide
acggactggaacattg

SEQ ID NO: 2958 - DNA, 16 bp, Artificial sequence
  Synthetic oligonucleotide
atgccatggacaagtt

SEQ ID NO: 2959 - DNA, 16 bp, Artificial sequence
  Synthetic oligonucleotide
ccacgaagattcaaaa

SEQ ID NO: 2960 - DNA, 16 bp, Artificial sequence
  Synthetic oligonucleotide
tgagcactcttactcc

SEQ ID NO: 2961 - DNA, 16 bp, Artificial sequence
  Synthetic oligonucleotide
tgttcagaaaccctca

SEQ ID NO: 2962 - DNA, 16 bp, Artificial sequence
  Synthetic oligonucleotide
cggttagctcatcccg

SEQ ID NO: 2963 - DNA, 16 bp, Artificial sequence
  Synthetic oligonucleotide
ggccaccgcacgcaag

SEQ ID NO: 2964 - DNA, 16 bp, Artificial sequence
  Synthetic oligonucleotide
cgacaagtggcgcaga

SEQ ID NO: 2965 - DNA, 16 bp, Artificial sequence
  Synthetic oligonucleotide
cgacacgcgccgctcg

SEQ ID NO: 2966 - DNA, 16 bp, Artificial sequence
  Synthetic oligonucleotide
ctttgaggctgcgaag

SEQ ID NO: 2967 - DNA, 16 bp, Artificial sequence
  Synthetic oligonucleotide
gcccggccgggccttc

SEQ ID NO: 2968 - DNA, 16 bp, Artificial sequence
  Synthetic oligonucleotide
ccacggacggaggcgg

SEQ ID NO: 2969 - DNA, 16 bp, Artificial sequence
  Synthetic oligonucleotide
agagacgcggtgagag

SEQ ID NO: 2970 - DNA, 16 bp, Artificial sequence
  Synthetic oligonucleotide
ccaaattcccggagga

SEQ ID NO: 2971 - DNA, 16 bp, Artificial sequence
  Synthetic oligonucleotide
ccggtagagtgagatg

SEQ ID NO: 2972 - DNA, 16 bp, Artificial sequence
  Synthetic oligonucleotide
atttacaccgttgctc

SEQ ID NO: 2973 - DNA, 16 bp, Artificial sequence
  Synthetic oligonucleotide
gaatggcgcataggtc

SEQ ID NO: 2974 - DNA, 16 bp, Artificial sequence
  Synthetic oligonucleotide
ggctccgctcaaccag

SEQ ID NO: 2975 - DNA, 16 bp, Artificial sequence
  Synthetic oligonucleotide
tgttaggtgacccaaa

SEQ ID NO: 2976 - DNA, 16 bp, Artificial sequence
  Synthetic oligonucleotide
taattctcctatgctg

SEQ ID NO: 2977 - DNA, 16 bp, Artificial sequence
  Synthetic oligonucleotide
attcaatgcacccccc

SEQ ID NO: 2978 - DNA, 16 bp, Artificial sequence
  Synthetic oligonucleotide
gacagatggcatgcga

SEQ ID NO: 2979 - DNA, 16 bp, Artificial sequence
  Synthetic oligonucleotide
ataacacggtgttgac

SEQ ID NO: 2980 - DNA, 16 bp, Artificial sequence
  Synthetic oligonucleotide
ggcggacacgcccgac

SEQ ID NO: 2981 - DNA, 16 bp, Artificial sequence
  Synthetic oligonucleotide
gctaaacctggcacca

SEQ ID NO: 2982 - DNA, 16 bp, Artificial sequence
  Synthetic oligonucleotide
cgaaaagactggagtg

SEQ ID NO: 2983 - DNA, 16 bp, Artificial sequence
  Synthetic oligonucleotide
gggttaaaggagtgca

SEQ ID NO: 2984 - DNA, 16 bp, Artificial sequence
  Synthetic oligonucleotide
gatttccgggtgtggc

SEQ ID NO: 2985 - DNA, 16 bp, Artificial sequence
  Synthetic oligonucleotide
ccccgagctgcacacg

SEQ ID NO: 2986 - DNA, 16 bp, Artificial sequence
  Synthetic oligonucleotide
acgaagggcagtgcct

SEQ ID NO: 2987 - DNA, 16 bp, Artificial sequence
  Synthetic oligonucleotide
gaacacaccactattc

SEQ ID NO: 2988 - DNA, 16 bp, Artificial sequence
  Synthetic oligonucleotide
ggaactcccgagggca

SEQ ID NO: 2989 - DNA, 16 bp, Artificial sequence
  Synthetic oligonucleotide
ggcctgagttaccgca

SEQ ID NO: 2990 - DNA, 16 bp, Artificial sequence
  Synthetic oligonucleotide
tacacctcttcactac

SEQ ID NO: 2991 - DNA, 16 bp, Artificial sequence
  Synthetic oligonucleotide
tatgttagccaattcc

SEQ ID NO: 2992 - DNA, 16 bp, Artificial sequence
  Synthetic oligonucleotide
aattccatagagccag

SEQ ID NO: 2993 - DNA, 16 bp, Artificial sequence
  Synthetic oligonucleotide
ctgttaccgatgcttc

SEQ ID NO: 2994 - DNA, 16 bp, Artificial sequence
  Synthetic oligonucleotide
tgtaactgactaacag

SEQ ID NO: 2995 - DNA, 16 bp, Artificial sequence
  Synthetic oligonucleotide
ctagacagagagtccg

SEQ ID NO: 2996 - DNA, 16 bp, Artificial sequence
  Synthetic oligonucleotide
agtgtctaaagtccca

SEQ ID NO: 2997 - DNA, 16 bp, Artificial sequence
  Synthetic oligonucleotide
gctgaaacggtcagca

SEQ ID NO: 2998 - DNA, 16 bp, Artificial sequence
  Synthetic oligonucleotide
cttaggcacatcaatg

SEQ ID NO: 2999 - DNA, 16 bp, Artificial sequence
  Synthetic oligonucleotide
gtaagatctccatggt

SEQ ID NO: 3000 - DNA, 16 bp, Artificial sequence
  Synthetic oligonucleotide
gtgtgcttgccaagcc

SEQ ID NO: 3001 - DNA, 16 bp, Artificial sequence
  Synthetic oligonucleotide
aaaaaggtgcaagcct

SEQ ID NO: 3002 - DNA, 16 bp, Artificial sequence
  Synthetic oligonucleotide
gaggttgccgagatat

SEQ ID NO: 3003 - DNA, 16 bp, Artificial sequence
  Synthetic oligonucleotide
aagcgagtcagacagt

SEQ ID NO: 3004 - DNA, 16 bp, Artificial sequence
  Synthetic oligonucleotide
ctgtatggaaccccaa

SEQ ID NO: 3005 - DNA, 16 bp, Artificial sequence
  Synthetic oligonucleotide
atgtaaagtctgctga

SEQ ID NO: 3006 - DNA, 16 bp, Artificial sequence
  Synthetic oligonucleotide
gtccacatacctgaaa

SEQ ID NO: 3007 - DNA, 16 bp, Artificial sequence
  Synthetic oligonucleotide
atagagcatcactatt

SEQ ID NO: 3008 - DNA, 16 bp, Artificial sequence
  Synthetic oligonucleotide
cagcatgagctcggtc

SEQ ID NO: 3009 - DNA, 16 bp, Artificial sequence
  Synthetic oligonucleotide
taacagataacgaggt

SEQ ID NO: 3010 - DNA, 16 bp, Artificial sequence
  Synthetic oligonucleotide
tcgagatcatagtgca

SEQ ID NO: 3011 - DNA, 16 bp, Artificial sequence
  Synthetic oligonucleotide
cctgtgcaaaaccagt

SEQ ID NO: 3012 - DNA, 16 bp, Artificial sequence
  Synthetic oligonucleotide
tggcgagtggcgggta

SEQ ID NO: 3013 - DNA, 16 bp, Artificial sequence
  Synthetic oligonucleotide
aagcttagttatctgg

SEQ ID NO: 3014 - DNA, 16 bp, Artificial sequence
  Synthetic oligonucleotide
aggacactcacaggcg

SEQ ID NO: 3015 - DNA, 16 bp, Artificial sequence
  Synthetic oligonucleotide
cagattaatagtaagt

SEQ ID NO: 3016 - DNA, 16 bp, Artificial sequence
  Synthetic oligonucleotide
ccgtgatctgagacta

SEQ ID NO: 3017 - DNA, 16 bp, Artificial sequence
  Synthetic oligonucleotide
tgacacaggagccgct

SEQ ID NO: 3018 - DNA, 16 bp, Artificial sequence
  Synthetic oligonucleotide
agatacaaaacggact

SEQ ID NO: 3019 - DNA, 16 bp, Artificial sequence
  Synthetic oligonucleotide
ttatgccatggacaag

SEQ ID NO: 3020 - DNA, 16 bp, Artificial sequence
  Synthetic oligonucleotide
acccacgaagattcaa

SEQ ID NO: 3021 - DNA, 16 bp, Artificial sequence
  Synthetic oligonucleotide
aggaatgagcactctt

SEQ ID NO: 3022 - DNA, 16 bp, Artificial sequence
  Synthetic oligonucleotide
agagaccatgttcaga

SEQ ID NO: 3023 - DNA, 16 bp, Artificial sequence
  Synthetic oligonucleotide
agatctgtggtaatct

SEQ ID NO: 3024 - DNA, 16 bp, Artificial sequence
  Synthetic oligonucleotide
ggcagttgtgccgtct

SEQ ID NO: 3025 - DNA, 16 bp, Artificial sequence
  Synthetic oligonucleotide
agggaccgcgccaggc

SEQ ID NO: 3026 - DNA, 16 bp, Artificial sequence
  Synthetic oligonucleotide
aacgacaagtggcgca

SEQ ID NO: 3027 - DNA, 16 bp, Artificial sequence
  Synthetic oligonucleotide
tcccgacacgcgccgc

SEQ ID NO: 3028 - DNA, 16 bp, Artificial sequence
  Synthetic oligonucleotide
ccacgaggccccggag

SEQ ID NO: 3029 - DNA, 16 bp, Artificial sequence
  Synthetic oligonucleotide
gacgaacgcgcaaaac

SEQ ID NO: 3030 - DNA, 16 bp, Artificial sequence
  Synthetic oligonucleotide
gcacggagagggcgag

SEQ ID NO: 3031 - DNA, 16 bp, Artificial sequence
  Synthetic oligonucleotide
acagagacgcggtgag

SEQ ID NO: 3032 - DNA, 16 bp, Artificial sequence
  Synthetic oligonucleotide
ggactaaggacagctg

SEQ ID NO: 3033 - DNA, 16 bp, Artificial sequence
  Synthetic oligonucleotide
taaccggtagagtgag

SEQ ID NO: 3034 - DNA, 16 bp, Artificial sequence
  Synthetic oligonucleotide
agatttacaccgttgc

SEQ ID NO: 3035 - DNA, 16 bp, Artificial sequence
  Synthetic oligonucleotide
aaagaatggcgcatag

SEQ ID NO: 3036 - DNA, 16 bp, Artificial sequence
  Synthetic oligonucleotide
gtctgagatgtccagc

SEQ ID NO: 3037 - DNA, 16 bp, Artificial sequence
  Synthetic oligonucleotide
cccacataactcaggc

SEQ ID NO: 3038 - DNA, 16 bp, Artificial sequence
  Synthetic oligonucleotide
gattaattctcctatg

SEQ ID NO: 3039 - DNA, 16 bp, Artificial sequence
  Synthetic oligonucleotide
tgagatattcctctca

SEQ ID NO: 3040 - DNA, 16 bp, Artificial sequence
  Synthetic oligonucleotide
tacaggacaggtaaag

SEQ ID NO: 3041 - DNA, 16 bp, Artificial sequence
  Synthetic oligonucleotide
tagaatgcataacacg

SEQ ID NO: 3042 - DNA, 16 bp, Artificial sequence
  Synthetic oligonucleotide
caggcggacacgcccg

SEQ ID NO: 3043 - DNA, 16 bp, Artificial sequence
  Synthetic oligonucleotide
atggctaaacctggca

SEQ ID NO: 3044 - DNA, 16 bp, Artificial sequence
  Synthetic oligonucleotide
tccgaaaagactggag

SEQ ID NO: 3045 - DNA, 16 bp, Artificial sequence
  Synthetic oligonucleotide
tgctaaaggagtgcag

SEQ ID NO: 3046 - DNA, 16 bp, Artificial sequence
  Synthetic oligonucleotide
ggtacgggatttccgg

SEQ ID NO: 3047 - DNA, 16 bp, Artificial sequence
  Synthetic oligonucleotide
agtgagaaaacccccc

SEQ ID NO: 3048 - DNA, 16 bp, Artificial sequence
  Synthetic oligonucleotide
ccacgaagggcagtgc

SEQ ID NO: 3049 - DNA, 16 bp, Artificial sequence
  Synthetic oligonucleotide
tttagtatcacctcta

SEQ ID NO: 3050 - DNA, 16 bp, Artificial sequence
  Synthetic oligonucleotide
agggagctcattttga

SEQ ID NO: 3051 - DNA, 16 bp, Artificial sequence
  Synthetic oligonucleotide
gaaggcctgagttacc

SEQ ID NO: 3052 - DNA, 16 bp, Artificial sequence
  Synthetic oligonucleotide
aaagagtggtacacct

SEQ ID NO: 3053 - DNA, 16 bp, Artificial sequence
  Synthetic oligonucleotide
ggagctagttttatgt

SEQ ID NO: 3054 - DNA, 16 bp, Artificial sequence
  Synthetic oligonucleotide
ttactaattccataga

SEQ ID NO: 3055 - DNA, 16 bp, Artificial sequence
  Synthetic oligonucleotide
actgttaccgatgctt

SEQ ID NO: 3056 - DNA, 16 bp, Artificial sequence
  Synthetic oligonucleotide
ctctgtaactgactaa

SEQ ID NO: 3057 - DNA, 16 bp, Artificial sequence
  Synthetic oligonucleotide
tgtcacctggcaacct

SEQ ID NO: 3058 - DNA, 16 bp, Artificial sequence
  Synthetic oligonucleotide
caagtgtctaaagtcc

SEQ ID NO: 3059 - DNA, 16 bp, Artificial sequence
  Synthetic oligonucleotide
ggctgaaacggtcagc

SEQ ID NO: 3060 - DNA, 16 bp, Artificial sequence
  Synthetic oligonucleotide
actcttaggcacatca

SEQ ID NO: 3061 - DNA, 16 bp, Artificial sequence
  Synthetic oligonucleotide
aggtaagatctccatg

SEQ ID NO: 3062 - DNA, 16 bp, Artificial sequence
  Synthetic oligonucleotide
ccttaagctatttggt

SEQ ID NO: 3063 - DNA, 16 bp, Artificial sequence
  Synthetic oligonucleotide
gttactcacgagcacc

SEQ ID NO: 3064 - DNA, 16 bp, Artificial sequence
  Synthetic oligonucleotide
acgaggttgccgagat

SEQ ID NO: 3065 - DNA, 16 bp, Artificial sequence
  Synthetic oligonucleotide
ctgaaagcgagtcaga

SEQ ID NO: 3066 - DNA, 16 bp, Artificial sequence
  Synthetic oligonucleotide
actgtatggaacccca

SEQ ID NO: 3067 - DNA, 16 bp, Artificial sequence
  Synthetic oligonucleotide
tcatgtaaagtctgct

SEQ ID NO: 3068 - DNA, 16 bp, Artificial sequence
  Synthetic oligonucleotide
aaagaagcaagtcggt

SEQ ID NO: 3069 - DNA, 16 bp, Artificial sequence
  Synthetic oligonucleotide
attatagagcatcact

SEQ ID NO: 3070 - DNA, 16 bp, Artificial sequence
  Synthetic oligonucleotide
ccacatgtcccgtggg

SEQ ID NO: 3071 - DNA, 16 bp, Artificial sequence
  Synthetic oligonucleotide
tctaacagataacgag

SEQ ID NO: 3072 - DNA, 16 bp, Artificial sequence
  Synthetic oligonucleotide
cctgaaaagagccgcc

SEQ ID NO: 3073 - DNA, 16 bp, Artificial sequence
  Synthetic oligonucleotide
taacttctcctgtgca

SEQ ID NO: 3074 - DNA, 16 bp, Artificial sequence
  Synthetic oligonucleotide
gtacgagcacatgtca

SEQ ID NO: 3075 - DNA, 16 bp, Artificial sequence
  Synthetic oligonucleotide
ctggcctgaagcttag

SEQ ID NO: 3076 - DNA, 16 bp, Artificial sequence
  Synthetic oligonucleotide
aagtctacagccccag

SEQ ID NO: 3077 - DNA, 16 bp, Artificial sequence
  Synthetic oligonucleotide
gcacagcccttggtta

SEQ ID NO: 3078 - DNA, 16 bp, Artificial sequence
  Synthetic oligonucleotide
cactgccgtgatctga

SEQ ID NO: 3079 - DNA, 16 bp, Artificial sequence
  Synthetic oligonucleotide
gaaacgagttgacaca

SEQ ID NO: 3080 - DNA, 16 bp, Artificial sequence
  Synthetic oligonucleotide
cgcttgtggatataca

SEQ ID NO: 3081 - DNA, 16 bp, Artificial sequence
  Synthetic oligonucleotide
agaccaatttatgcca

SEQ ID NO: 3082 - DNA, 16 bp, Artificial sequence
  Synthetic oligonucleotide
cagcattggacccacg

SEQ ID NO: 3083 - DNA, 16 bp, Artificial sequence
  Synthetic oligonucleotide
agaggaatgagcactc

SEQ ID NO: 3084 - DNA, 16 bp, Artificial sequence
  Synthetic oligonucleotide
tgtagaagcccacaag

SEQ ID NO: 3085 - DNA, 16 bp, Artificial sequence
  Synthetic oligonucleotide
gatagatctgtggtaa

SEQ ID NO: 3086 - DNA, 16 bp, Artificial sequence
  Synthetic oligonucleotide
ggaacgaagagcaggg

SEQ ID NO: 3087 - DNA, 16 bp, Artificial sequence
  Synthetic oligonucleotide
gcagggaccgcgccag

SEQ ID NO: 3088 - DNA, 16 bp, Artificial sequence
  Synthetic oligonucleotide
gcaaacgacaagtggc

SEQ ID NO: 3089 - DNA, 16 bp, Artificial sequence
  Synthetic oligonucleotide
ccgcagcccaaaggct

SEQ ID NO: 3090 - DNA, 16 bp, Artificial sequence
  Synthetic oligonucleotide
cgcactccgggcaccc

SEQ ID NO: 3091 - DNA, 16 bp, Artificial sequence
  Synthetic oligonucleotide
acggacgaacgcgcaa

SEQ ID NO: 3092 - DNA, 16 bp, Artificial sequence
  Synthetic oligonucleotide
ggacgcacggagaggg

SEQ ID NO: 3093 - DNA, 16 bp, Artificial sequence
  Synthetic oligonucleotide
agaaacagagacgcgg

SEQ ID NO: 3094 - DNA, 16 bp, Artificial sequence
  Synthetic oligonucleotide
taggactaaggacagc

SEQ ID NO: 3095 - DNA, 16 bp, Artificial sequence
  Synthetic oligonucleotide
atttataaccggtaga

SEQ ID NO: 3096 - DNA, 16 bp, Artificial sequence
  Synthetic oligonucleotide
cagatttacaccgttg

SEQ ID NO: 3097 - DNA, 16 bp, Artificial sequence
  Synthetic oligonucleotide
gcataggcatccttcc

SEQ ID NO: 3098 - DNA, 16 bp, Artificial sequence
  Synthetic oligonucleotide
cgggtctgagatgtcc

SEQ ID NO: 3099 - DNA, 16 bp, Artificial sequence
  Synthetic oligonucleotide
gtgacccacataactc

SEQ ID NO: 3100 - DNA, 16 bp, Artificial sequence
  Synthetic oligonucleotide
gtgtgattaattctcc

SEQ ID NO: 3101 - DNA, 16 bp, Artificial sequence
  Synthetic oligonucleotide
gatgagatattcctct

SEQ ID NO: 3102 - DNA, 16 bp, Artificial sequence
  Synthetic oligonucleotide
tgtacaggacaggtaa

SEQ ID NO: 3103 - DNA, 16 bp, Artificial sequence
  Synthetic oligonucleotide
acctaactaaatgtca

SEQ ID NO: 3104 - DNA, 16 bp, Artificial sequence
  Synthetic oligonucleotide
attccaacaggcggac

SEQ ID NO: 3105 - DNA, 16 bp, Artificial sequence
  Synthetic oligonucleotide
atatggctaaacctgg

SEQ ID NO: 3106 - DNA, 16 bp, Artificial sequence
  Synthetic oligonucleotide
atccgaaaagactgga

SEQ ID NO: 3107 - DNA, 16 bp, Artificial sequence
  Synthetic oligonucleotide
tgtgaacctgctaaag

SEQ ID NO: 3108 - DNA, 16 bp, Artificial sequence
  Synthetic oligonucleotide
ttggtacgggatttcc

SEQ ID NO: 3109 - DNA, 16 bp, Artificial sequence
  Synthetic oligonucleotide
tgggatgccaccatcc

SEQ ID NO: 3110 - DNA, 16 bp, Artificial sequence
  Synthetic oligonucleotide
taagatcccacgaagg

SEQ ID NO: 3111 - DNA, 16 bp, Artificial sequence
  Synthetic oligonucleotide
ccgttccttttttagt

SEQ ID NO: 3112 - DNA, 16 bp, Artificial sequence
  Synthetic oligonucleotide
tagattctccctgcac

SEQ ID NO: 3113 - DNA, 16 bp, Artificial sequence
  Synthetic oligonucleotide
gttcagtgtgttgacc

SEQ ID NO: 3114 - DNA, 16 bp, Artificial sequence
  Synthetic oligonucleotide
tgctgcaaatccctct

SEQ ID NO: 3115 - DNA, 16 bp, Artificial sequence
  Synthetic oligonucleotide
tttcaggagctagttt

SEQ ID NO: 3116 - DNA, 16 bp, Artificial sequence
  Synthetic oligonucleotide
catggttactaattcc

SEQ ID NO: 3117 - DNA, 16 bp, Artificial sequence
  Synthetic oligonucleotide
tactgttaccgatgct

SEQ ID NO: 3118 - DNA, 16 bp, Artificial sequence
  Synthetic oligonucleotide
gcgctctctctgtaac

SEQ ID NO: 3119 - DNA, 16 bp, Artificial sequence
  Synthetic oligonucleotide
ctgtcacctggcaacc

SEQ ID NO: 3120 - DNA, 16 bp, Artificial sequence
  Synthetic oligonucleotide
aatcaccctggtcacc

SEQ ID NO: 3121 - DNA, 16 bp, Artificial sequence
  Synthetic oligonucleotide
acttatttgtggctca

SEQ ID NO: 3122 - DNA, 16 bp, Artificial sequence
  Synthetic oligonucleotide
attactcttaggcaca

SEQ ID NO: 3123 - DNA, 16 bp, Artificial sequence
  Synthetic oligonucleotide
gtaggtaagatctcca

SEQ ID NO: 3124 - DNA, 16 bp, Artificial sequence
  Synthetic oligonucleotide
aaccttaagctatttg

SEQ ID NO: 3125 - DNA, 16 bp, Artificial sequence
  Synthetic oligonucleotide
tcagttactcacgagc

SEQ ID NO: 3126 - DNA, 16 bp, Artificial sequence
  Synthetic oligonucleotide
aatcacgaggttgccg

SEQ ID NO: 3127 - DNA, 16 bp, Artificial sequence
  Synthetic oligonucleotide
tttgagacttaaccca

SEQ ID NO: 3128 - DNA, 16 bp, Artificial sequence
  Synthetic oligonucleotide
taactgtatggaaccc

SEQ ID NO: 3129 - DNA, 16 bp, Artificial sequence
  Synthetic oligonucleotide
ctggatatgtggtgtt

SEQ ID NO: 3130 - DNA, 16 bp, Artificial sequence
  Synthetic oligonucleotide
tataacggtgtttcag

SEQ ID NO: 3131 - DNA, 16 bp, Artificial sequence
  Synthetic oligonucleotide
tcctattatagagcat

SEQ ID NO: 3132 - DNA, 16 bp, Artificial sequence
  Synthetic oligonucleotide
aacgactccacagagc

SEQ ID NO: 3133 - DNA, 16 bp, Artificial sequence
  Synthetic oligonucleotide
gccgaagtcaacagga

SEQ ID NO: 3134 - DNA, 16 bp, Artificial sequence
  Synthetic oligonucleotide
tccaacctttatgatt

SEQ ID NO: 3135 - DNA, 16 bp, Artificial sequence
  Synthetic oligonucleotide
tataacttctcctgtg

SEQ ID NO: 3136 - DNA, 16 bp, Artificial sequence
  Synthetic oligonucleotide
gaagtacgagcacatg

SEQ ID NO: 3137 - DNA, 16 bp, Artificial sequence
  Synthetic oligonucleotide
cagcaccgtggtgcga

SEQ ID NO: 3138 - DNA, 16 bp, Artificial sequence
  Synthetic oligonucleotide
gcaagtctacagcccc

SEQ ID NO: 3139 - DNA, 16 bp, Artificial sequence
  Synthetic oligonucleotide
ataacatgagagtgtt

SEQ ID NO: 3140 - DNA, 16 bp, Artificial sequence
  Synthetic oligonucleotide
cacactgccgtgatct

SEQ ID NO: 3141 - DNA, 16 bp, Artificial sequence
  Synthetic oligonucleotide
aaagaaacgagttgac

SEQ ID NO: 3142 - DNA, 16 bp, Artificial sequence
  Synthetic oligonucleotide
agtaacttgacttgag

SEQ ID NO: 3143 - DNA, 16 bp, Artificial sequence
  Synthetic oligonucleotide
atggcaaaagaccaat

SEQ ID NO: 3144 - DNA, 16 bp, Artificial sequence
  Synthetic oligonucleotide
tgctttgcagcattgg

SEQ ID NO: 3145 - DNA, 16 bp, Artificial sequence
  Synthetic oligonucleotide
agcttactgtgattct

SEQ ID NO: 3146 - DNA, 16 bp, Artificial sequence
  Synthetic oligonucleotide
cttggcagggagcggc

SEQ ID NO: 3147 - DNA, 16 bp, Artificial sequence
  Synthetic oligonucleotide
cggatagatctgtggt

SEQ ID NO: 3148 - DNA, 16 bp, Artificial sequence
  Synthetic oligonucleotide
ccttaggaacgaagag

SEQ ID NO: 3149 - DNA, 16 bp, Artificial sequence
  Synthetic oligonucleotide
aggcagggaccgcgcc

SEQ ID NO: 3150 - DNA, 16 bp, Artificial sequence
  Synthetic oligonucleotide
ctgcaaacgacaagtg

SEQ ID NO: 3151 - DNA, 16 bp, Artificial sequence
  Synthetic oligonucleotide
acgcacccgcagccca

SEQ ID NO: 3152 - DNA, 16 bp, Artificial sequence
  Synthetic oligonucleotide
aggcaccgcactccgg

SEQ ID NO: 3153 - DNA, 16 bp, Artificial sequence
  Synthetic oligonucleotide
cgcacggacgaacgcg

SEQ ID NO: 3154 - DNA, 16 bp, Artificial sequence
  Synthetic oligonucleotide
gcggacgcacggagag

SEQ ID NO: 3155 - DNA, 16 bp, Artificial sequence
  Synthetic oligonucleotide
gctagcaggagcgaga

SEQ ID NO: 3156 - DNA, 16 bp, Artificial sequence
  Synthetic oligonucleotide
cctaggactaaggaca

SEQ ID NO: 3157 - DNA, 16 bp, Artificial sequence
  Synthetic oligonucleotide
ggtatttataaccggt

SEQ ID NO: 3158 - DNA, 16 bp, Artificial sequence
  Synthetic oligonucleotide
tcagatttacaccgtt

SEQ ID NO: 3159 - DNA, 16 bp, Artificial sequence
  Synthetic oligonucleotide
gttgcataggcatcct

SEQ ID NO: 3160 - DNA, 16 bp, Artificial sequence
  Synthetic oligonucleotide
cactttgtacgggtct

SEQ ID NO: 3161 - DNA, 16 bp, Artificial sequence
  Synthetic oligonucleotide
acttgtgacccacata

SEQ ID NO: 3162 - DNA, 16 bp, Artificial sequence
  Synthetic oligonucleotide
cagtgtgattaattct

SEQ ID NO: 3163 - DNA, 16 bp, Artificial sequence
  Synthetic oligonucleotide
cgccagccagatgttt

SEQ ID NO: 3164 - DNA, 16 bp, Artificial sequence
  Synthetic oligonucleotide
gttgtacaggacaggt

SEQ ID NO: 3165 - DNA, 16 bp, Artificial sequence
  Synthetic oligonucleotide
caggaactgacctaac

SEQ ID NO: 3166 - DNA, 16 bp, Artificial sequence
  Synthetic oligonucleotide
catattccaacaggcg

SEQ ID NO: 3167 - DNA, 16 bp, Artificial sequence
  Synthetic oligonucleotide
gtcatatggctaaacc

SEQ ID NO: 3168 - DNA, 16 bp, Artificial sequence
  Synthetic oligonucleotide
gactgacagccgaagc

SEQ ID NO: 3169 - DNA, 16 bp, Artificial sequence
  Synthetic oligonucleotide
ggcatcatgtagttgt

SEQ ID NO: 3170 - DNA, 16 bp, Artificial sequence
  Synthetic oligonucleotide
acattggtacgggatt

SEQ ID NO: 3171 - DNA, 16 bp, Artificial sequence
  Synthetic oligonucleotide
cttggctgtgggatgc

SEQ ID NO: 3172 - DNA, 16 bp, Artificial sequence
  Synthetic oligonucleotide
aaataagatcccacga

SEQ ID NO: 3173 - DNA, 16 bp, Artificial sequence
  Synthetic oligonucleotide
ggtatttttccgttcc

SEQ ID NO: 3174 - DNA, 16 bp, Artificial sequence
  Synthetic oligonucleotide
gctagattctccctgc

SEQ ID NO: 3175 - DNA, 16 bp, Artificial sequence
  Synthetic oligonucleotide
tccaaagggttcagtg

SEQ ID NO: 3176 - DNA, 16 bp, Artificial sequence
  Synthetic oligonucleotide
cccttgctgcaaatcc

SEQ ID NO: 3177 - DNA, 16 bp, Artificial sequence
  Synthetic oligonucleotide
aacgcaagtctgaatt

SEQ ID NO: 3178 - DNA, 16 bp, Artificial sequence
  Synthetic oligonucleotide
tcccatggttactaat

SEQ ID NO: 3179 - DNA, 16 bp, Artificial sequence
  Synthetic oligonucleotide
tcatttactgttaccg

SEQ ID NO: 3180 - DNA, 16 bp, Artificial sequence
  Synthetic oligonucleotide
aacgagccagtgcaca

SEQ ID NO: 3181 - DNA, 16 bp, Artificial sequence
  Synthetic oligonucleotide
aggttcctgtcacctg

SEQ ID NO: 3182 - DNA, 16 bp, Artificial sequence
  Synthetic oligonucleotide
ggtgctcctaaatcac

SEQ ID NO: 3183 - DNA, 16 bp, Artificial sequence
  Synthetic oligonucleotide
gacttatttgtggctc

SEQ ID NO: 3184 - DNA, 16 bp, Artificial sequence
  Synthetic oligonucleotide
tgtattactcttaggc

SEQ ID NO: 3185 - DNA, 16 bp, Artificial sequence
  Synthetic oligonucleotide
ctttatagtaggtaag

SEQ ID NO: 3186 - DNA, 16 bp, Artificial sequence
  Synthetic oligonucleotide
caaaccttaagctatt

SEQ ID NO: 3187 - DNA, 16 bp, Artificial sequence
  Synthetic oligonucleotide
caagacaagggtttga

SEQ ID NO: 3188 - DNA, 16 bp, Artificial sequence
  Synthetic oligonucleotide
aaatcacgaggttgcc

SEQ ID NO: 3189 - DNA, 16 bp, Artificial sequence
  Synthetic oligonucleotide
tgtatcatgcatacca

SEQ ID NO: 3190 - DNA, 16 bp, Artificial sequence
  Synthetic oligonucleotide
ctggtaactgtatgga

SEQ ID NO: 3191 - DNA, 16 bp, Artificial sequence
  Synthetic oligonucleotide
actggatatgtggtgt

SEQ ID NO: 3192 - DNA, 16 bp, Artificial sequence
  Synthetic oligonucleotide
aatataacggtgtttc

SEQ ID NO: 3193 - DNA, 16 bp, Artificial sequence
  Synthetic oligonucleotide
gaacaagtgtatcttt

SEQ ID NO: 3194 - DNA, 16 bp, Artificial sequence
  Synthetic oligonucleotide
ggacaccacctcgagg

SEQ ID NO: 3195 - DNA, 16 bp, Artificial sequence
  Synthetic oligonucleotide
tctactggagtcaagc

SEQ ID NO: 3196 - DNA, 16 bp, Artificial sequence
  Synthetic oligonucleotide
tccaccctccgtctca

SEQ ID NO: 3197 - DNA, 16 bp, Artificial sequence
  Synthetic oligonucleotide
cctataacttctcctg

SEQ ID NO: 3198 - DNA, 16 bp, Artificial sequence
  Synthetic oligonucleotide
ccagaagtacgagcac

SEQ ID NO: 3199 - DNA, 16 bp, Artificial sequence
  Synthetic oligonucleotide
tgcagcaccgtggtgc

SEQ ID NO: 3200 - DNA, 16 bp, Artificial sequence
  Synthetic oligonucleotide
cgcgcaagtctacagc

SEQ ID NO: 3201 - DNA, 16 bp, Artificial sequence
  Synthetic oligonucleotide
tccaaccctagataac

SEQ ID NO: 3202 - DNA, 16 bp, Artificial sequence
  Synthetic oligonucleotide
ttcacactgccgtgat

SEQ ID NO: 3203 - DNA, 16 bp, Artificial sequence
  Synthetic oligonucleotide
ccgcaaaagaaacgag

SEQ ID NO: 3204 - DNA, 16 bp, Artificial sequence
  Synthetic oligonucleotide
atggaacagtaacttg

SEQ ID NO: 3205 - DNA, 16 bp, Artificial sequence
  Synthetic oligonucleotide
gtcacgcaatggcaaa

SEQ ID NO: 3206 - DNA, 16 bp, Artificial sequence
  Synthetic oligonucleotide
aactagtcgacagcta

SEQ ID NO: 3207 - DNA, 16 bp, Artificial sequence
  Synthetic oligonucleotide
agcaagagcttactgt

SEQ ID NO: 3208 - DNA, 16 bp, Artificial sequence
  Synthetic oligonucleotide
gaatcttggcagggag

SEQ ID NO: 3209 - DNA, 16 bp, Artificial sequence
  Synthetic oligonucleotide
gaatggcggatagatc

SEQ ID NO: 3210 - DNA, 16 bp, Artificial sequence
  Synthetic oligonucleotide
ccccttaggaacgaag

SEQ ID NO: 3211 - DNA, 16 bp, Artificial sequence
  Synthetic oligonucleotide
agctgcggagcctggg

SEQ ID NO: 3212 - DNA, 16 bp, Artificial sequence
  Synthetic oligonucleotide
ggctctgcaaacgaca

SEQ ID NO: 3213 - DNA, 16 bp, Artificial sequence
  Synthetic oligonucleotide
tgtaacgcacccgcag

SEQ ID NO: 3214 - DNA, 16 bp, Artificial sequence
  Synthetic oligonucleotide
gtccgccccgcgcggt

SEQ ID NO: 3215 - DNA, 16 bp, Artificial sequence
  Synthetic oligonucleotide
agaacgcacggacgaa

SEQ ID NO: 3216 - DNA, 16 bp, Artificial sequence
  Synthetic oligonucleotide
ggcgcggacgcacgga

SEQ ID NO: 3217 - DNA, 16 bp, Artificial sequence
  Synthetic oligonucleotide
tcgcgcaaagggcaag

SEQ ID NO: 3218 - DNA, 16 bp, Artificial sequence
  Synthetic oligonucleotide
cggaggttccttgagg

SEQ ID NO: 3219 - DNA, 16 bp, Artificial sequence
  Synthetic oligonucleotide
tgggtatttataaccg

SEQ ID NO: 3220 - DNA, 16 bp, Artificial sequence
  Synthetic oligonucleotide
ccttcagatttacacc

SEQ ID NO: 3221 - DNA, 16 bp, Artificial sequence
  Synthetic oligonucleotide
atgttgcataggcatc

SEQ ID NO: 3222 - DNA, 16 bp, Artificial sequence
  Synthetic oligonucleotide
cctgtacactttgtac

SEQ ID NO: 3223 - DNA, 16 bp, Artificial sequence
  Synthetic oligonucleotide
tcaacttgtgacccac

SEQ ID NO: 3224 - DNA, 16 bp, Artificial sequence
  Synthetic oligonucleotide
tgaggcatacagtgtg

SEQ ID NO: 3225 - DNA, 16 bp, Artificial sequence
  Synthetic oligonucleotide
cataaaggaccccgcc

SEQ ID NO: 3226 - DNA, 16 bp, Artificial sequence
  Synthetic oligonucleotide
ctgagttgtacaggac

SEQ ID NO: 3227 - DNA, 16 bp, Artificial sequence
  Synthetic oligonucleotide
aatggcagcaccgtgt

SEQ ID NO: 3228 - DNA, 16 bp, Artificial sequence
  Synthetic oligonucleotide
taaggcactacttcca

SEQ ID NO: 3229 - DNA, 16 bp, Artificial sequence
  Synthetic oligonucleotide
gagatacttgtactgt

SEQ ID NO: 3230 - DNA, 16 bp, Artificial sequence
  Synthetic oligonucleotide
tagactgacagccgaa

SEQ ID NO: 3231 - DNA, 16 bp, Artificial sequence
  Synthetic oligonucleotide
gggtggcatcatgtag

SEQ ID NO: 3232 - DNA, 16 bp, Artificial sequence
  Synthetic oligonucleotide
catgggacattggtac

SEQ ID NO: 3233 - DNA, 16 bp, Artificial sequence
  Synthetic oligonucleotide
gagagtaaacttggct

SEQ ID NO: 3234 - DNA, 16 bp, Artificial sequence
  Synthetic oligonucleotide
tatttatgagcttcca

SEQ ID NO: 3235 - DNA, 16 bp, Artificial sequence
  Synthetic oligonucleotide
catggtatttttccgt

SEQ ID NO: 3236 - DNA, 16 bp, Artificial sequence
  Synthetic oligonucleotide
ttgctagattctccct

SEQ ID NO: 3237 - DNA, 16 bp, Artificial sequence
  Synthetic oligonucleotide
aaacatccaaagggtt

SEQ ID NO: 3238 - DNA, 16 bp, Artificial sequence
  Synthetic oligonucleotide
agcccttgctgcaaat

SEQ ID NO: 3239 - DNA, 16 bp, Artificial sequence
  Synthetic oligonucleotide
gtaaacgcaagtctga

SEQ ID NO: 3240 - DNA, 16 bp, Artificial sequence
  Synthetic oligonucleotide
ctttcccatggttact

SEQ ID NO: 3241 - DNA, 16 bp, Artificial sequence
  Synthetic oligonucleotide
cacctgatcttgctgc

SEQ ID NO: 3242 - DNA, 16 bp, Artificial sequence
  Synthetic oligonucleotide
tgatggagaaacgagc

SEQ ID NO: 3243 - DNA, 16 bp, Artificial sequence
  Synthetic oligonucleotide
aaaaggttcctgtcac

SEQ ID NO: 3244 - DNA, 16 bp, Artificial sequence
  Synthetic oligonucleotide
ctaatggtgctcctaa

SEQ ID NO: 3245 - DNA, 16 bp, Artificial sequence
  Synthetic oligonucleotide
gaggacttatttgtgg

SEQ ID NO: 3246 - DNA, 16 bp, Artificial sequence
  Synthetic oligonucleotide
tgtgtattactcttag

SEQ ID NO: 3247 - DNA, 16 bp, Artificial sequence
  Synthetic oligonucleotide
tctttatagtaggtaa

SEQ ID NO: 3248 - DNA, 16 bp, Artificial sequence
  Synthetic oligonucleotide
attccaaaccttaagc

SEQ ID NO: 3249 - DNA, 16 bp, Artificial sequence
  Synthetic oligonucleotide
gttcaagacaagggtt

SEQ ID NO: 3250 - DNA, 16 bp, Artificial sequence
  Synthetic oligonucleotide
cagaaatcacgaggtt

SEQ ID NO: 3251 - DNA, 16 bp, Artificial sequence
  Synthetic oligonucleotide
atctgtatcatgcata

SEQ ID NO: 3252 - DNA, 16 bp, Artificial sequence
  Synthetic oligonucleotide
ctgccactggtaactg

SEQ ID NO: 3253 - DNA, 16 bp, Artificial sequence
  Synthetic oligonucleotide
gggtggtagaatgtga

SEQ ID NO: 3254 - DNA, 16 bp, Artificial sequence
  Synthetic oligonucleotide
atgaaccctaagttta

SEQ ID NO: 3255 - DNA, 16 bp, Artificial sequence
  Synthetic oligonucleotide
aaggaacaagtgtatc

SEQ ID NO: 3256 - DNA, 16 bp, Artificial sequence
  Synthetic oligonucleotide
ctccggagtcagtgct

SEQ ID NO: 3257 - DNA, 16 bp, Artificial sequence
  Synthetic oligonucleotide
gaccatctgatccgga

SEQ ID NO: 3258 - DNA, 16 bp, Artificial sequence
  Synthetic oligonucleotide
acagtccactccaccc

SEQ ID NO: 3259 - DNA, 16 bp, Artificial sequence
  Synthetic oligonucleotide
acttatagcactctcc

SEQ ID NO: 3260 - DNA, 16 bp, Artificial sequence
  Synthetic oligonucleotide
aaacttgggtcactta

SEQ ID NO: 3261 - DNA, 16 bp, Artificial sequence
  Synthetic oligonucleotide
cttagaatgagaggtg

SEQ ID NO: 3262 - DNA, 16 bp, Artificial sequence
  Synthetic oligonucleotide
agtcgcgcaagtctac

SEQ ID NO: 3263 - DNA, 16 bp, Artificial sequence
  Synthetic oligonucleotide
ggcgagttggcacaat

SEQ ID NO: 3264 - DNA, 16 bp, Artificial sequence
  Synthetic oligonucleotide
cattcacactgccgtg

SEQ ID NO: 3265 - DNA, 16 bp, Artificial sequence
  Synthetic oligonucleotide
gcccgcaaaagaaacg

SEQ ID NO: 3266 - DNA, 16 bp, Artificial sequence
  Synthetic oligonucleotide
tctgagtagacttctt

SEQ ID NO: 3267 - DNA, 16 bp, Artificial sequence
  Synthetic oligonucleotide
cgtagtcacgcaatgg

SEQ ID NO: 3268 - DNA, 16 bp, Artificial sequence
  Synthetic oligonucleotide
ggaactagtcgacagc

SEQ ID NO: 3269 - DNA, 16 bp, Artificial sequence
  Synthetic oligonucleotide
accgaacacaccaggt

SEQ ID NO: 3270 - DNA, 16 bp, Artificial sequence
  Synthetic oligonucleotide
tctccaaagcatagag

SEQ ID NO: 3271 - DNA, 16 bp, Artificial sequence
  Synthetic oligonucleotide
attcttgaatagagga

SEQ ID NO: 3272 - DNA, 16 bp, Artificial sequence
  Synthetic oligonucleotide
atgttagccaattcct

SEQ ID NO: 3273 - DNA, 16 bp, Artificial sequence
  Synthetic oligonucleotide
ttatgttagccaattc

SEQ ID NO: 3274 - DNA, 16 bp, Artificial sequence
  Synthetic oligonucleotide
tttatgttagccaatt

SEQ ID NO: 3275 - DNA, 16 bp, Artificial sequence
  Synthetic oligonucleotide
gtgtctaaagtcccat

SEQ ID NO: 3276 - DNA, 16 bp, Artificial sequence
  Synthetic oligonucleotide
aagtgtctaaagtccc

SEQ ID NO: 3277 - DNA, 16 bp, Artificial sequence
  Synthetic oligonucleotide
aagcagtgatgtcagg

SEQ ID NO: 3278 - DNA, 16 bp, Artificial sequence
  Synthetic oligonucleotide
caagcagtgatgtcag

SEQ ID NO: 3279 - DNA, 16 bp, Artificial sequence
  Synthetic oligonucleotide
cacatcaatgttttag

SEQ ID NO: 3280 - DNA, 16 bp, Artificial sequence
  Synthetic oligonucleotide
ggcacatcaatgtttt

SEQ ID NO: 3281 - DNA, 16 bp, Artificial sequence
  Synthetic oligonucleotide
atgtgtattactctta

SEQ ID NO: 3282 - DNA, 16 bp, Artificial sequence
  Synthetic oligonucleotide
aatgtgtattactctt

SEQ ID NO: 3283 - DNA, 16 bp, Artificial sequence
  Synthetic oligonucleotide
tgtgcttgccaagcct

SEQ ID NO: 3284 - DNA, 16 bp, Artificial sequence
  Synthetic oligonucleotide
cgtgtgcttgccaagc

SEQ ID NO: 3285 - DNA, 16 bp, Artificial sequence
  Synthetic oligonucleotide
acgtgtgcttgccaag

SEQ ID NO: 3286 - DNA, 16 bp, Artificial sequence
  Synthetic oligonucleotide
ttcatgtaaagtctgc

SEQ ID NO: 3287 - DNA, 16 bp, Artificial sequence
  Synthetic oligonucleotide
aagttcatgtaaagtc

SEQ ID NO: 3288 - DNA, 16 bp, Artificial sequence
  Synthetic oligonucleotide
actaagcttgataaag

SEQ ID NO: 3289 - DNA, 16 bp, Artificial sequence
  Synthetic oligonucleotide
agtgttccaggagata

SEQ ID NO: 3290 - DNA, 16 bp, Artificial sequence
  Synthetic oligonucleotide
gctcccgacacgcgcc

SEQ ID NO: 3291 - DNA, 16 bp, Artificial sequence
  Synthetic oligonucleotide
atgcggaggttccttg

SEQ ID NO: 3292 - DNA, 16 bp, Artificial sequence
  Synthetic oligonucleotide
tgagatgcggaggttc

SEQ ID NO: 3293 - DNA, 16 bp, Artificial sequence
  Synthetic oligonucleotide
agtgagatgcggaggt

SEQ ID NO: 3294 - DNA, 16 bp, Artificial sequence
  Synthetic oligonucleotide
agagtgagatgcggag

SEQ ID NO: 3295 - DNA, 16 bp, Artificial sequence
  Synthetic oligonucleotide
accggtagagtgagat

SEQ ID NO: 3296 - DNA, 16 bp, Artificial sequence
  Synthetic oligonucleotide
gagttgtacaggacag

SEQ ID NO: 3297 - DNA, 16 bp, Artificial sequence
  Synthetic oligonucleotide
gtctgagttgtacagg

SEQ ID NO: 3298 - DNA, 16 bp, Artificial sequence
  Synthetic oligonucleotide
aggtctgagttgtaca

SEQ ID NO: 3299 - DNA, 16 bp, Artificial sequence
  Synthetic oligonucleotide
aatggagatacttgta

SEQ ID NO: 3300 - DNA, 16 bp, Artificial sequence
  Synthetic oligonucleotide
gacaatggagatactt

SEQ ID NO: 3301 - DNA, 16 bp, Artificial sequence
  Synthetic oligonucleotide
ttccgggtgtggctga

SEQ ID NO: 3302 - DNA, 16 bp, Artificial sequence
  Synthetic oligonucleotide
atttccgggtgtggct

SEQ ID NO: 3303 - DNA, 16 bp, Artificial sequence
  Synthetic oligonucleotide
gtatttttccgttcct

SEQ ID NO: 3304 - DNA, 16 bp, Artificial sequence
  Synthetic oligonucleotide
atggtatttttccgtt

SEQ ID NO: 3305 - DNA, 16 bp, Artificial sequence
  Synthetic oligonucleotide
gtttgccatggtattt

SEQ ID NO: 3306 - DNA, 16 bp, Artificial sequence
  Synthetic oligonucleotide
cattgctagattctcc

SEQ ID NO: 3307 - DNA, 16 bp, Artificial sequence
  Synthetic oligonucleotide
ttaccgcattgctaga

SEQ ID NO: 3308 - DNA, 16 bp, Artificial sequence
  Synthetic oligonucleotide
ctgagttaccgcattg

SEQ ID NO: 3309 - DNA, 16 bp, Artificial sequence
  Synthetic oligonucleotide
ttagccaattcctcca

SEQ ID NO: 3310 - DNA, 16 bp, Artificial sequence
  Synthetic oligonucleotide
accgatgcttcaagac

SEQ ID NO: 3311 - DNA, 16 bp, Artificial sequence
  Synthetic oligonucleotide
ttaccgatgcttcaag

SEQ ID NO: 3312 - DNA, 16 bp, Artificial sequence
  Synthetic oligonucleotide
ttactgttaccgatgc

SEQ ID NO: 3313 - DNA, 16 bp, Artificial sequence
  Synthetic oligonucleotide
gcaagtgtctaaagtc

SEQ ID NO: 3314 - DNA, 16 bp, Artificial sequence
  Synthetic oligonucleotide
ttaggcacatcaatgt

SEQ ID NO: 3315 - DNA, 16 bp, Artificial sequence
  Synthetic oligonucleotide
ttactcttaggcacat

SEQ ID NO: 3316 - DNA, 16 bp, Artificial sequence
  Synthetic oligonucleotide
gatctccatggtgcag

SEQ ID NO: 3317 - DNA, 16 bp, Artificial sequence
  Synthetic oligonucleotide
taggtaagatctccat

SEQ ID NO: 3318 - DNA, 16 bp, Artificial sequence
  Synthetic oligonucleotide
gtgcttgccaagccta

SEQ ID NO: 3319 - DNA, 16 bp, Artificial sequence
  Synthetic oligonucleotide
ccaaaccttaagctat

SEQ ID NO: 3320 - DNA, 16 bp, Artificial sequence
  Synthetic oligonucleotide
aattccaaaccttaag

SEQ ID NO: 3321 - DNA, 16 bp, Artificial sequence
  Synthetic oligonucleotide
aggttgccgagatata

SEQ ID NO: 3322 - DNA, 16 bp, Artificial sequence
  Synthetic oligonucleotide
cgaggttgccgagata

SEQ ID NO: 3323 - DNA, 16 bp, Artificial sequence
  Synthetic oligonucleotide
gagccaacttatagca

SEQ ID NO: 3324 - DNA, 16 bp, Artificial sequence
  Synthetic oligonucleotide
cagagccaacttatag

SEQ ID NO: 3325 - DNA, 16 bp, Artificial sequence
  Synthetic oligonucleotide
gaagcttagttatctg

SEQ ID NO: 3326 - DNA, 16 bp, Artificial sequence
  Synthetic oligonucleotide
ggcctgaagcttagtt

SEQ ID NO: 3327 - DNA, 16 bp, Artificial sequence
  Synthetic oligonucleotide
gtcgcgcaagtctaca

SEQ ID NO: 3328 - DNA, 16 bp, Artificial sequence
  Synthetic oligonucleotide
gttggcacaattctct

SEQ ID NO: 3329 - DNA, 16 bp, Artificial sequence
  Synthetic oligonucleotide
gcgagttggcacaatt

SEQ ID NO: 3330 - DNA, 16 bp, Artificial sequence
  Synthetic oligonucleotide
atggcgagttggcaca

SEQ ID NO: 3331 - DNA, 16 bp, Artificial sequence
  Synthetic oligonucleotide
gaatggcgagttggca

SEQ ID NO: 3332 - DNA, 16 bp, Artificial sequence
  Synthetic oligonucleotide
cgtgatctgagactac

SEQ ID NO: 3333 - DNA, 16 bp, Artificial sequence
  Synthetic oligonucleotide
actgccgtgatctgag

SEQ ID NO: 3334 - DNA, 16 bp, Artificial sequence
  Synthetic oligonucleotide
tagatctgtggtaatc

SEQ ID NO: 3335 - DNA, 16 bp, Artificial sequence
  Synthetic oligonucleotide
aatggcggatagatct

SEQ ID NO: 3336 - DNA, 16 bp, Artificial sequence
  Synthetic oligonucleotide
gttggctggtctttgt

SEQ ID NO: 3337 - DNA, 16 bp, Artificial sequence
  Synthetic oligonucleotide
ggttggctggtctttg

SEQ ID NO: 3338 - DNA, 16 bp, Artificial sequence
  Synthetic oligonucleotide
tggttggctggtcttt

SEQ ID NO: 3339 - DNA, 16 bp, Artificial sequence
  Synthetic oligonucleotide
ttggttggctggtctt

SEQ ID NO: 3340 - DNA, 16 bp, Artificial sequence
  Synthetic oligonucleotide
attatatactggttgg

SEQ ID NO: 3341 - DNA, 16 bp, Artificial sequence
  Synthetic oligonucleotide
gggattatatactggt

SEQ ID NO: 3342 - DNA, 16 bp, Artificial sequence
  Synthetic oligonucleotide
tgggattatatactgg

SEQ ID NO: 3343 - DNA, 16 bp, Artificial sequence
  Synthetic oligonucleotide
gtgatagctgagctga

SEQ ID NO: 3344 - DNA, 16 bp, Artificial sequence
  Synthetic oligonucleotide
tgtgatagctgagctg

SEQ ID NO: 3345 - DNA, 16 bp, Artificial sequence
  Synthetic oligonucleotide
atgtgatagctgagct

SEQ ID NO: 3346 - DNA, 16 bp, Artificial sequence
  Synthetic oligonucleotide
gatgtgatagctgagc

SEQ ID NO: 3347 - DNA, 16 bp, Artificial sequence
  Synthetic oligonucleotide
tgatgtgatagctgag

SEQ ID NO: 3348 - DNA, 16 bp, Artificial sequence
  Synthetic oligonucleotide
ttgatgtgatagctga

SEQ ID NO: 3349 - DNA, 16 bp, Artificial sequence
  Synthetic oligonucleotide
agtgacttgcatccat

SEQ ID NO: 3350 - DNA, 16 bp, Artificial sequence
  Synthetic oligonucleotide
cagtgacttgcatcca

SEQ ID NO: 3351 - DNA, 16 bp, Artificial sequence
  Synthetic oligonucleotide
acagtgacttgcatcc

SEQ ID NO: 3352 - DNA, 16 bp, Artificial sequence
  Synthetic oligonucleotide
gacagtgacttgcatc

SEQ ID NO: 3353 - DNA, 16 bp, Artificial sequence
  Synthetic oligonucleotide
ttacgcttatttttcc

SEQ ID NO: 3354 - DNA, 16 bp, Artificial sequence
  Synthetic oligonucleotide
caatcttaacctggag

SEQ ID NO: 3355 - DNA, 16 bp, Artificial sequence
  Synthetic oligonucleotide
atactggttggttggc

SEQ ID NO: 3356 - DNA, 16 bp, Artificial sequence
  Synthetic oligonucleotide
gccgatcatcaacttc

SEQ ID NO: 3357 - DNA, 16 bp, Artificial sequence
  Synthetic oligonucleotide
cccggccgatcatcaa

SEQ ID NO: 3358 - DNA, 16 bp, Artificial sequence
  Synthetic oligonucleotide
atagctgagctgatca

SEQ ID NO: 3359 - DNA, 16 bp, Artificial sequence
  Synthetic oligonucleotide
tggattgatgtgatag

SEQ ID NO: 3360 - DNA, 16 bp, Artificial sequence
  Synthetic oligonucleotide
acttgcatccatgtca

SEQ ID NO: 3361 - DNA, 16 bp, Artificial sequence
  Synthetic oligonucleotide
gtgacttgcatccatg

SEQ ID NO: 3362 - DNA, 16 bp, Artificial sequence
  Synthetic oligonucleotide
aagtggaactcatagg

SEQ ID NO: 3363 - DNA, 16 bp, Artificial sequence
  Synthetic oligonucleotide
atctgtatagttctca

SEQ ID NO: 3364 - DNA, 16 bp, Artificial sequence
  Synthetic oligonucleotide
taatctgtatagttct

SEQ ID NO: 3365 - DNA, 16 bp, Artificial sequence
  Synthetic oligonucleotide
tctggctagcagaggt

SEQ ID NO: 3366 - DNA, 16 bp, Artificial sequence
  Synthetic oligonucleotide
atgtgttctggtaaat

SEQ ID NO: 3367 - DNA, 16 bp, Artificial sequence
  Synthetic oligonucleotide
tggattgctgatgtgt

SEQ ID NO: 3368 - DNA, 16 bp, Artificial sequence
  Synthetic oligonucleotide
tctggattgctgatgt

SEQ ID NO: 3369 - DNA, 16 bp, Artificial sequence
  Synthetic oligonucleotide
tcttctggattgctga

SEQ ID NO: 3370 - DNA, 16 bp, Artificial sequence
  Synthetic oligonucleotide
aatcttctggattgct

SEQ ID NO: 3371 - DNA, 16 bp, Artificial sequence
  Synthetic oligonucleotide
agaacattacgagagg

SEQ ID NO: 3372 - DNA, 16 bp, Artificial sequence
  Synthetic oligonucleotide
cgatcatcaacttctt

SEQ ID NO: 3373 - DNA, 16 bp, Artificial sequence
  Synthetic oligonucleotide
actggattgatgtgat

SEQ ID NO: 3374 - DNA, 16 bp, Artificial sequence
  Synthetic oligonucleotide
ggaactcataggtgta

SEQ ID NO: 3375 - DNA, 16 bp, Artificial sequence
  Synthetic oligonucleotide
ctgatgtgttctggta

SEQ ID NO: 3376 - DNA, 16 bp, Artificial sequence
  Synthetic oligonucleotide
tacgcttatttttcca

SEQ ID NO: 3377 - DNA, 16 bp, Artificial sequence
  Synthetic oligonucleotide
gcaatcttaacctgga

SEQ ID NO: 3378 - DNA, 16 bp, Artificial sequence
  Synthetic oligonucleotide
ggattgatgtgatagc

SEQ ID NO: 3379 - DNA, 16 bp, Artificial sequence
  Synthetic oligonucleotide
tctgtatagttctcaa

SEQ ID NO: 3380 - DNA, 16 bp, Artificial sequence
  Synthetic oligonucleotide
tagttgtctggctagc

SEQ ID NO: 3381 - DNA, 16 bp, Artificial sequence
  Synthetic oligonucleotide
tgtctggctagcagag

SEQ ID NO: 3382 - DNA, 16 bp, Artificial sequence
  Synthetic oligonucleotide
cgtagcccctcaggaa

SEQ ID NO: 3383 - DNA, 16 bp, Artificial sequence
  Synthetic oligonucleotide
ctggattgctgatgtg

SEQ ID NO: 3384 - DNA, 16 bp, Artificial sequence
  Synthetic oligonucleotide
cgccgataaggtacac

SEQ ID NO: 3385 - DNA, 16 bp, Artificial sequence
  Synthetic oligonucleotide
ggctactacgccgtca

SEQ ID NO: 3386 - DNA, 21 bp, Artificial sequence
  Primer
aagccttggcgttctcagact

SEQ ID NO: 3387 - DNA, 22 bp, Artificial sequence
  Primer
tcagctccttcacgaggatttc

SEQ ID NO: 3388 - DNA, 26 bp, Artificial sequence
  Probe
ccggctgcacatctgcctgtactacc

SEQ ID NO: 3389 - DNA, 21 bp, Artificial sequence
  Primer
ggcaaagaaagctcatcacag

SEQ ID NO: 3390 - DNA, 22 bp, Artificial sequence
  Primer
ggattgctgatgtgttctggta

SEQ ID NO: 3391 - DNA, 24 bp, Artificial sequence
  Probe
tagcccctcaggaaatgtccactg

SEQ ID NO: 3392 - DNA, 20 bp, Artificial sequence
  Primer
cggaaatcccgtaccaatgt

SEQ ID NO: 3393 - DNA, 21 bp, Artificial sequence
  Primer
tggcaaccattttcacaagct

SEQ ID NO: 3394 - DNA, 18 bp, Artificial sequence
  Probe
tttggaccccgcggccac

SEQ ID NO: 3395 - DNA, 19 bp, Artificial sequence
  Primer
tcccgtgttgcttcaaact

SEQ ID NO: 3396 - DNA, 20 bp, Artificial sequence
  Primer
tacctgctggcagttctttc

SEQ ID NO: 3397 - DNA, 26 bp, Artificial sequence
  Probe
acagatgggacttaacaggcaatggg

SEQ ID NO: 3398 - DNA, 24 bp, Artificial sequence
  Primer
cggactatgacttagttgcgttac

SEQ ID NO: 3399 - DNA, 21 bp, Artificial sequence
  Primer
gccatgccaatctcatcttgt

SEQ ID NO: 3400 - DNA, 30 bp, Artificial sequence
  Probe
cctttcttgacaaaacctaacttgcgcaga

What is claimed:
1. A modified oligonucleotide according to the following chemical structure:
(SEQ ID NO: 2021)
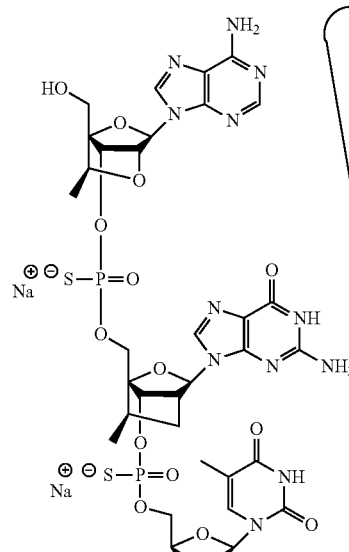
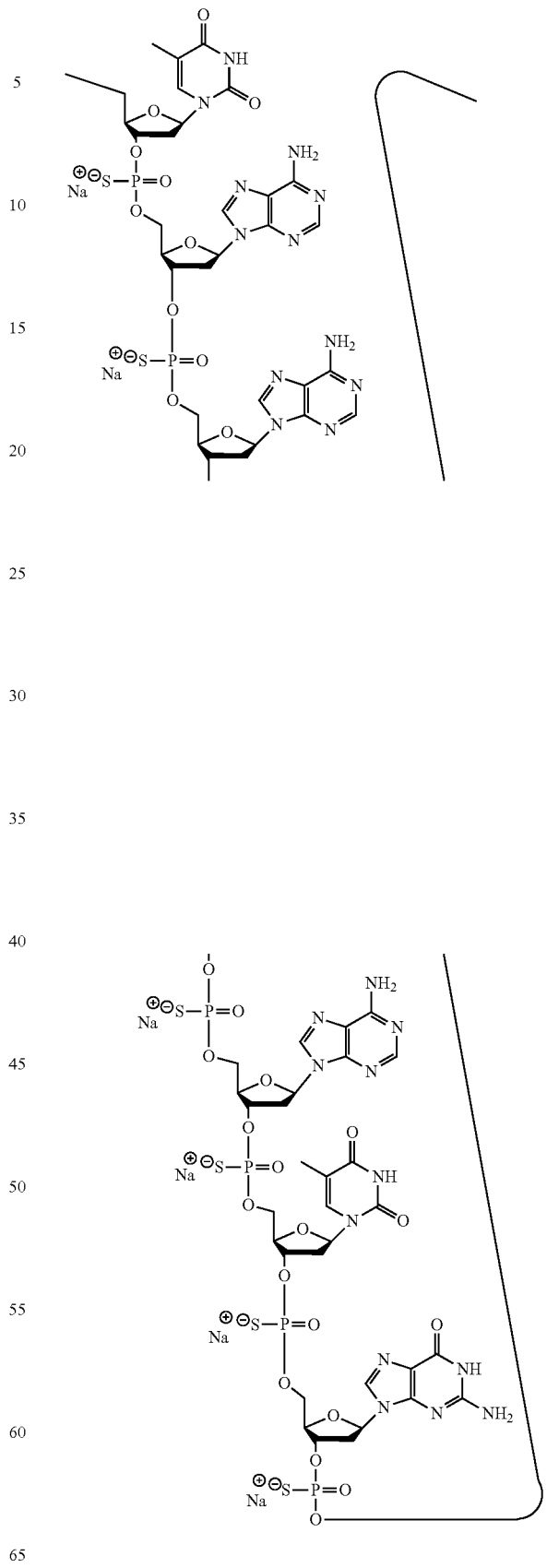

-continued

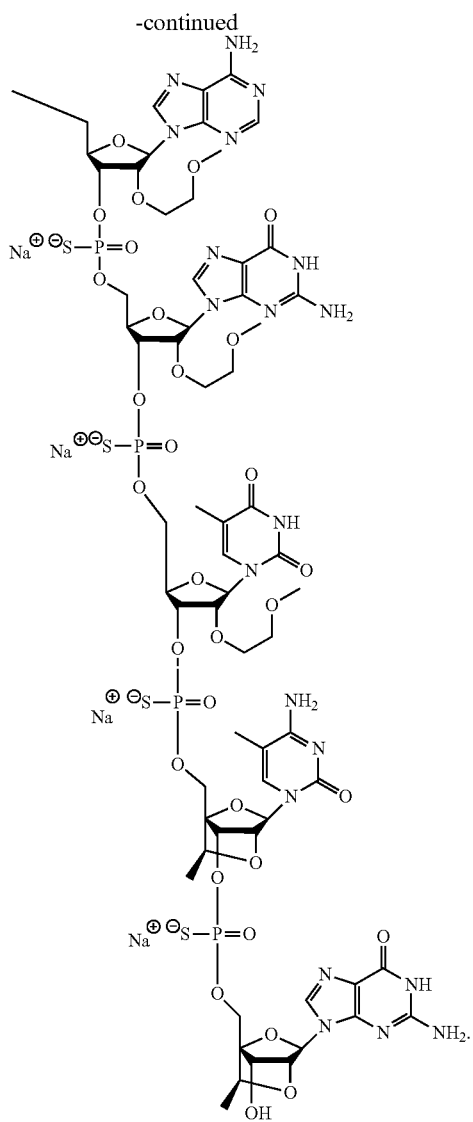

2. A composition comprising the modified oligonucleotide of claim 1 and a pharmaceutically acceptable carrier.

3. The composition of claim 2, wherein the pharmaceutically acceptable carrier is water.

4. The composition of claim 2, wherein the pharmaceutically acceptable carrier is phosphate buffered saline (PBS).

5. A method of treating cancer in an individual comprising administering to the individual the compound of claim 1.

6. The method of claim 5, wherein the cancer is a blood cancer, myeloma, multiple myeloma, B cell malignancy, lymphoma, B cell lymphoma, T cell lymphoma, or leukemia.

7. The method of claim 6, wherein the cancer is multiple myeloma.

8. The method of claim 5, wherein administering the compound inhibits or reduces cancer cell proliferation, tumor growth, or metastasis.

9. The method of claim 6, wherein administering the compound inhibits or reduces cancer cell proliferation, tumor growth, or metastasis.

10. The method of claim 7, wherein administering the compound inhibits or reduces cancer cell proliferation, tumor growth, or metastasis.

11. A method of treating cancer in an individual comprising administering to the individual the composition of claim 2.

12. The method of claim 11, wherein the cancer is a blood cancer, myeloma, multiple myeloma, B cell malignancy, lymphoma, B cell lymphoma, T cell lymphoma, or leukemia.

13. The method of claim 12, wherein the cancer is multiple myeloma.

14. The method of claim 11, wherein administering the composition inhibits or reduces cancer cell proliferation, tumor growth, or metastasis.

15. The method of claim 12, wherein administering the composition inhibits or reduces cancer cell proliferation, tumor growth, or metastasis.

16. The method of claim 13, wherein administering the composition inhibits or reduces cancer cell proliferation, tumor growth, or metastasis.

17. The method of claim 5, wherein the compound is administered parenterally.

18. The method of claim 11, wherein the composition is administered parenterally.

19. A method of inhibiting expression of IRF4 in a cancer cell comprising contacting the cancer cell with the compound of claim 1.

20. The method of claim 19, wherein the cancer cell is a bone marrow cell, lymphoid cell, or lymph node cell.

21. A method of inhibiting expression of IRF4 in a cancer cell comprising contacting the cancer cell with the composition of claim 2.

22. The method of claim 21, wherein the cancer cell is a bone marrow cell, lymphoid cell, or lymph node cell.

* * * * *

UNITED STATES PATENT AND TRADEMARK OFFICE
CERTIFICATE OF CORRECTION

Page 1 of 2

PATENT NO. : 11,241,451 B2
APPLICATION NO. : 16/977260
DATED : February 8, 2022
INVENTOR(S) : Tianyuan Zhou et al.

It is certified that error appears in the above-identified patent and that said Letters Patent is hereby corrected as shown below:

In the Claims

Column 409, Claim 1, Lines 7 to 30, the structure appears as follows:

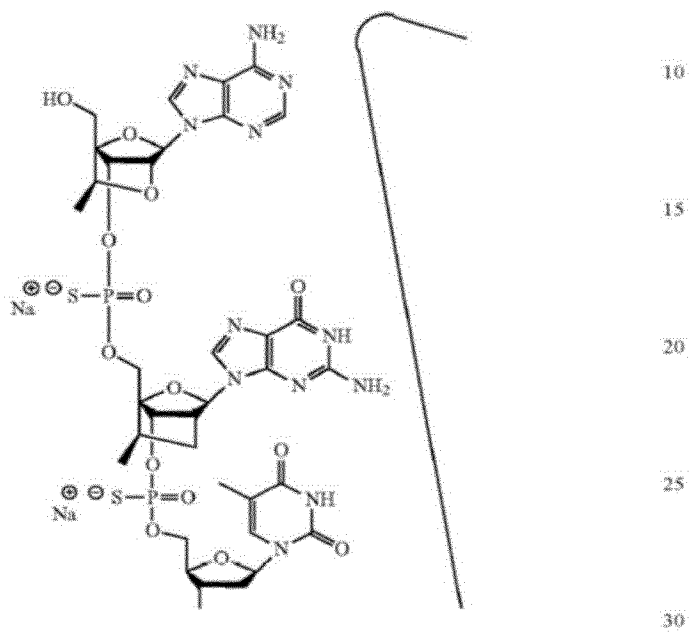

Signed and Sealed this
Fourteenth Day of June, 2022

Katherine Kelly Vidal
*Director of the United States Patent and Trademark Office*

CERTIFICATE OF CORRECTION (continued)
U.S. Pat. No. 11,241,451 B2

Should appear as follows:

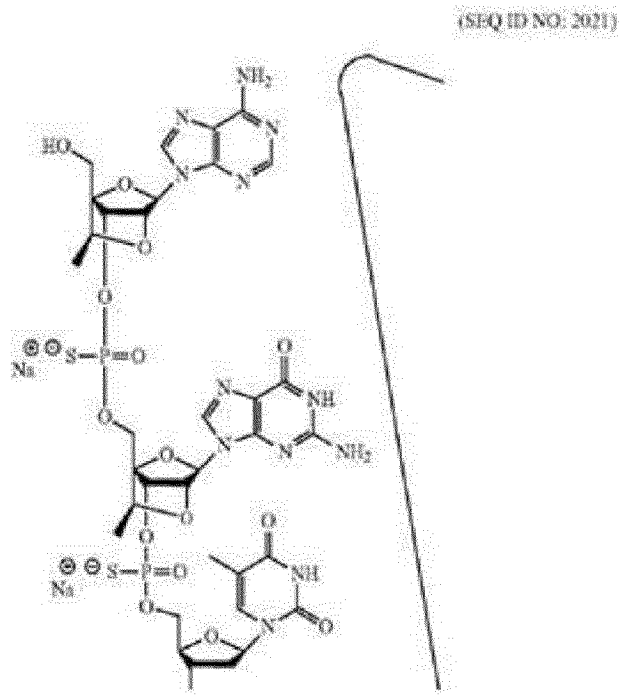

(SEQ ID NO: 2021)